(12) United States Patent
Blelloch et al.

(10) Patent No.: US 9,790,557 B2
(45) Date of Patent: Oct. 17, 2017

(54) METHODS AND SYSTEMS FOR DETERMINING A LIKELIHOOD OF ADVERSE PROSTATE CANCER PATHOLOGY

(71) Applicant: The Regents of the University of California, Oakland, CA (US)

(72) Inventors: Robert Hector Blelloch, San Francisco, CA (US); Siao-Yi Wang, Long Beach, CA (US)

(73) Assignee: The Regents of the University of California, Oakland, CA (US)

( * ) Notice: Subject to any disclaimer, the term of this patent is extended or adjusted under 35 U.S.C. 154(b) by 0 days.

(21) Appl. No.: 14/686,593

(22) Filed: Apr. 14, 2015

(65) Prior Publication Data

US 2015/0211077 A1 Jul. 30, 2015

Related U.S. Application Data

(63) Continuation of application No. PCT/US2013/068126, filed on Nov. 1, 2013.

(60) Provisional application No. 61/721,699, filed on Nov. 2, 2012.

(51) Int. Cl.
  *C12Q 1/68* (2006.01)
  *C07H 21/04* (2006.01)
  *G06F 19/00* (2011.01)

(52) U.S. Cl.
  CPC ....... *C12Q 1/6886* (2013.01); *G06F 19/3431* (2013.01); *G06F 19/3487* (2013.01); *C12Q 2600/112* (2013.01); *C12Q 2600/118* (2013.01); *C12Q 2600/158* (2013.01); *C12Q 2600/166* (2013.01); *C12Q 2600/178* (2013.01)

(58) Field of Classification Search
  None
  See application file for complete search history.

(56) References Cited

U.S. PATENT DOCUMENTS

| | | | |
|---|---|---|---|
| 2008/0182239 A1* | 7/2008 | Mullinax | C12Q 1/6811 435/6.14 |
| 2008/0254481 A1* | 10/2008 | Love | G01N 33/564 435/7.1 |
| 2009/0298701 A1* | 12/2009 | Baker | C12Q 1/6886 506/7 |
| 2010/0113290 A1 | 5/2010 | Klass et al. | |
| 2010/0297652 A1* | 11/2010 | Shelton | C12Q 1/6886 435/6.1 |
| 2011/0275534 A1 | 11/2011 | Cohn et al. | |
| 2012/0028264 A1* | 2/2012 | Shak | C12Q 1/6886 435/6.14 |
| 2012/0264638 A1 | 10/2012 | Brase et al. | |

FOREIGN PATENT DOCUMENTS

| | | | |
|---|---|---|---|
| WO | 2009143379 | | 11/2009 |
| WO | WO 2011/021177 | * | 2/2011 |
| WO | WO 2011/080315 | * | 7/2011 |

OTHER PUBLICATIONS

Esteller (Nature Reviews Genetic vol. 12 Dec. 2011 pp. 861-874).*
Krell et al. Frontiers in Bioscience (Elite Edition), vol. 5, pp. 204-213, Jan. 2013; e.g., Abstract.*
McShane et al. British Journal of Cancer, vol. 93, pp. 387-391, 2005.*
Liang (BMC Genomics 2007, 8:166 pp. 1-20).*
Ason (PNAS Sep. 26, 2006 vol. 103 No. 39 pp. 14385-14389).*
Moltzahn (Cancer Res vol. 71 No. 2 pp. 550-560 Jan. 15, 2011).*
Moltzahn (Cancer Res vol. 71 No. 2 pp. 550-560 Jan. 15, 2011 pre-pub online Nov. 22, 2010 plus supplementary tables).*
Little, et al., (2012) "Multigene Panels in Prostate Cancer Risk Assessment" Evidence Report/Technology Assessment; 209, 8 pages.
Albertsen et al. (2005) "20-Year Outcomes Following Conservative Management of Clinically Localized Prostate Cancer," JAMA; 293:2095-2101.
Auvinen et al. (1996) "Screening for Prostate Cancer Using Serum Prostate-Specific Antigen: a Randomised, Population-Based Pilot Study in Finland," British Journal of Cancer; 74:568-572.
Bissels et al. (2009) "Absolute quantification of microRNAs by using a universal reference," RNA; 15(12):2375-2384.
Cooperberg (2010) "Understanding and Applying Rish Assesment for Prostate Cancer," PCRI Insights; 13(4):3-7.
Cooperberg, M et al. (2005) "The UCSF Cancer of the Prostate Risk Assessment (CAPRA) Score: a Straightforward and Reliable Preoperative Predictor of Disease Recurrence After Radical Prostatectomy," J Urol.; 173(6):1938-1942.
Cronin et al. (2004) "Universal RNA Reference Materials for Gene Expression," Clin. Chem; 50(8):1464-1471.
Duttagupta et al. (2011) "Impact of Cellular miRNAs on Circulating miRNA Biomarker Signatures," PLoS One; 6(6):e20769.
Galiveti et al. (2010) "Application of housekeeping npcRNAs for quantitative expression analysis of human transcriptome by real-time PCR," RNA; 16(2):450-461.
Hassan et al. (2012) "Recent Updates on the Role of microRNAs in Prostate Cancer," Journal of Hematology & Oncology; 5(9):1-10.
Heidenreich et al. (2008) "EAU Guidelines on Prostate Cancer," Eur Urol; 53:68-80.

(Continued)

*Primary Examiner* — Amanda Haney
(74) *Attorney, Agent, or Firm* — Carol L. Francis; Bozicevic, Field & Francis LLP

(57) ABSTRACT

The present disclosure provides methods that find use in determining a likelihood of adverse prostate cancer pathology in a subject. The methods generally involve detection of one or more diagnostic microRNAs (miRNAs), such as mir-19a, mir-19b, mir-519c-5p, and/or mir-345 in a biological sample from the subject, such as blood or blood product. The detection of one or more such diagnostic miRNAs can be used to determine a likelihood of adverse prostate cancer pathology in a subject. The methods of the present disclosure also find use in facilitating treatment decisions for a subject. Also provided are devices, systems, and kits that may be used in practicing methods of the present disclosure.

11 Claims, 33 Drawing Sheets

(56) References Cited

OTHER PUBLICATIONS

Hothron, et al. (2006) "Unbiased Recursive Partitioning: A Conditional Inference Framework," J. Comp. and Graph. Stat.; 15:651-674.

Kirschner et al. (2011) "Haemolysis during Sample Preparation Alters microRNA Content of Plasma," PLoS One; 6(9):e24145.

Kozomara and Griffiths-Jones (2011) "miRBase: integrating microRNA annotation and deep-sequencing data," Nucleic Acids Res.; 39(Database Issue):D152-D157.

Mestdagh et al. (2009) "A novel and universal method for microRNA RT-qPCR data normalization," Genome Biol.; 10(6):R64.

Meyer et al. (2012) "Profound Effect of Profiling Platform and Normalization Strategy on Detection of Differentially Expressed Micro RNAs—A Comparative Study," PLoS One; 7(6):e38946.

Mitchell et al. (2008) "Circulating microRNAs as stable blood-based markers for cancer detection," PNAS; 105(30):10513-10518.

McCall and Irizarry (2008) "Consolidated strategy for the analysis of microarray spike-in data," Nucleic Acids Res.; 36(17): e108.

Moltzahn et al. (2011) "High Throughput MicroRNA Profiling: Optimized Multiplex qRT-PCR at Nanoliter Scale on the Fluidigm Dynamic Array™ IFCs," J. Vis. Exp.; (54):e2552.

Moltzahn, et al. (2011) "Microfluidic based multiplex qRT-PCR identifies diagnostic and prognostic microRNA signatures in sera of prostate cancer patients," Cancer Res.; 71:550-560.

Peltier and Latham (2008) "Normalization of microRNA expression levels in quantitative RT-PCR assays: Identification of suitable reference RNA targets in normal and cancerous human solid tissues," RNA; 14(5):844-852.

Roa et al. (2010) "Identification of a new microRNA expression profile as a potential cancer screening tool," Clin Invest Med; 33(2):e124-e132.

Schaefer et al. (2010) "Suitable reference genes for relative quantification of miRNA expression in prostate cancer," Exp. Mol. Med.; 42(11):749-758.

Shariat et al. (2008) "An Updated Catalog of Prostate Cancer Predictive Tools," Cancer; 113(11):3075-3099.

Shariat et al. (2008) "Inventory of prostate cancer predictive tools," Curr. Opin. Urol.; 18(3):279-296.

Timoneda et al. (2012) "Determination of Reference microRNAs for Relative Quantification in Porcine Tissues," PLoS One; 7(9):e44413.

Wylie et al. (2011) "A novel mean-centering method for normalizing microRNA expression from high-throughput RT-qPCR data," BMC Res Notes; 4:555.

Suardi et al. (2008) "Currently Used Criteria for Active Surveillance in Men With Low-risk Prostate Cancer," Cancer; 113:2068-2072.

* cited by examiner

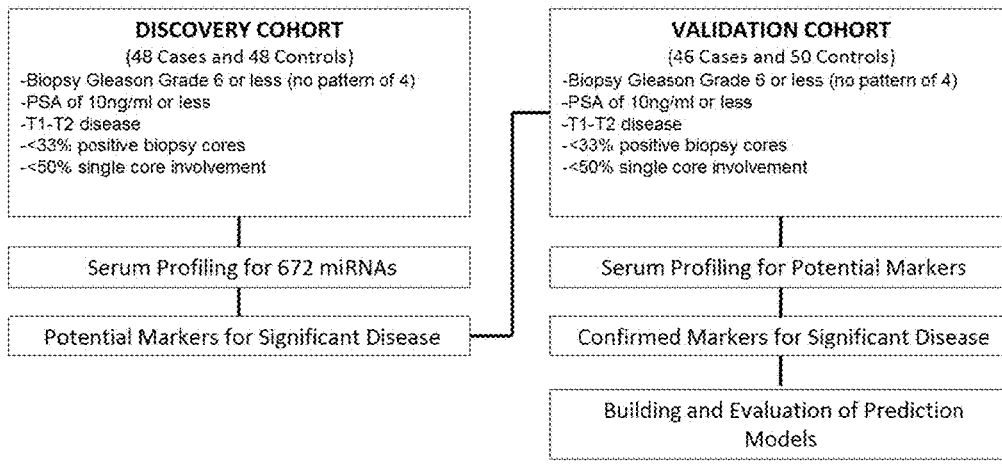

FIG. 3

| MicroRNA | MicroRNA Cluster or Family |
|---|---|
| mir-17 | mir-17-92 cluster |
| mir-19a | mir-17-92 cluster |
| mir-20a | mir-17-92 cluster |
| mir-19b | mir-17-92/106a-363 clusters |
| mir-92a | mir-17-92/106a-363 clusters |
| mir-106a | mir-106a-363 cluster |
| mir-93 | mir-106b-25 cluster |
| mir-25 | mir-106b-25 cluster |
| let-7b | let-7 cluster |
| mir-24 | mir-181c/23b clusters |
| mir-939 | mir-1234 cluster |
| mir-1234 | mir-1234 cluster |
| mir-519c-5p | mir-1283 cluster |
| mir-522 | mir-1283 cluster |
| mir-525-5p | mir-1283 cluster |
| mir-660 | mir-188 cluster |
| mir-941 | mir-1914 cluster |
| mir-1274a | mir-1274 cluster |
| mir-1274b | mir-1274 cluster |
| mir-302f | mir-302 family |
| mir-34c-3p | mir-34 family |
| mir-663 | mir-663 family |
| mir-197 | |
| mir-223 | |
| mir-297 | |
| mir-345 | |
| mir-346 | |
| mir-484 | |
| mir-486 | |
| mir-584 | |
| mir-638 | |
| mir-629 | |
| mir-720 | |
| mir-942 | |
| mir-1208 | |
| mir-1243 | |

A

| miRNA* | OR** | 95% CI (P) | AUC† | 95% CI (P‡) |
|---|---|---|---|---|
| mir-19a | 4.21 | 1.1, 14.75 (0.024) | 0.73 | 0.62, 0.83 (0.22) |
| mir-19b | 5.68 | 2.00, 16.15 (<0.001) | 0.77 | 0.67, 0.86 (0.07) |
| mir-345 | 0.12 | 0.04, 0.42 (0.001) | 0.77 | 0.68, 0.87 (0.04) |
| mir-519c-5p | 0.21 | 0.08, 0.52 (0.001) | 0.76 | 0.67 0.86 (0.09) |

B

| miRNA* | OR** | 95% CI (P) | AUC† | 95% CI (P‡) |
|---|---|---|---|---|
| mir-19a | 8.78 | 3.23, 23.95 (<0.001) | 0.81 | 0.72, 0.90 (0.016) |
| mir-19b | 10.37 | 3.74, 28.78 (<0.001) | 0.83 | 0.74, 0.91 (0.007) |
| mir-345 | 0.43 | 0.13, 1.40 (0.16) | 0.71 | 0.58, 0.79 (0.181) |
| mir-519c-5p | 0.07 | 0.02, 0.24 (<0.001) | 0.82 | 0.74, 0.91 (0.006) |

|  | CAPRA | | | Total |
| --- | --- | --- | --- | --- |
|  | 0 | 1 | 2 |  |
| Control | 9 | 28 | 13 | 50 |
|  | 90.0% | 50.0% | 43.3% | 52.1% |
| Cases | 1 | 28 | 17 | 46 |
|  | 10.0% | 50.0% | 56.7% | 47.9% |
| Total | 10 | 56 | 30 | 96 |

B

|  | miRNA + CAPRA | | | | | Total |
| --- | --- | --- | --- | --- | --- | --- |
|  | 1 | 2 | 3 | 4 | 5 |  |
| Control | 21 | 14 | 8 | 7 | 0 | 50 |
|  | 91.3% | 63.6% | 44.4% | 30.4% | 0.0% | 52.1% |
| Cases | 2 | 8 | 10 | 16 | 10 | 46 |
|  | 8.7% | 36.4% | 55.6% | 69.6% | 100.0% | 47.9% |
| Total | 23 | 22 | 18 | 23 | 10 | 96 |

FIG. 12

| MicroRNA | MicroRNA Cluster or Family |
|---|---|
| miR-17 | miR-17-92 cluster |
| miR-19a | miR-17-92 cluster |
| miR-20a | miR-17-92 cluster |
| miR-19b | miR-17-92/106a-363 clusters |
| miR-92a | miR-17-92/106a-363 clusters |
| miR-106a | miR-106a-363 cluster |
| miR-93 | miR-106b-25 cluster |
| miR-25 | miR-106b-25 cluster |
| let-7b | let-7 cluster |
| miR-24 | miR-181c/23b clusters |
| miR-939 | miR-1234 cluster |
| miR-1234 | miR-1234 cluster |
| miR-519c-5p | miR-1283 cluster |
| miR-522 | miR-1283 cluster |
| miR-525-5p | miR-1283 cluster |
| miR-660 | miR-188 cluster |
| miR-941 | miR-1914 cluster |
| miR-1274a | miR-1274 cluster |
| miR-1274b | miR-1274 cluster |
| miR-302f | miR-302 family |
| miR-34c-3p | miR-34 family |
| miR-663 | miR-663 family |
| miR-197 | |
| miR-223 | |
| miR-297 | |
| miR-345 | |
| miR-346 | |
| miR-484 | |
| miR-486 | |
| miR-584 | |
| miR-638 | |
| miR-629 | |
| miR-720 | |
| miR-942 | |
| miR-1208 | |
| miR-1243 | |

FIG. 13

| | DISCOVERY COHORT (n = 96) | | | |
|---|---|---|---|---|
| miRNA* | OR** | 95% CI (P) | AUC† | 95% CI (P‡) |
| miR_19a | 4.82 | 1.20, 19.33 (0.026) | 0.75 | 0.65, 0.85 (0.41) |
| miR_19b | 5.57 | 1.81, 17.12 (0.003) | 0.77 | 0.68, 0.87 (0.25) |
| miR_345 | 0.13 | 0.03, 0.47 (0.002) | 0.78 | 0.68, 0.87 (0.19) |
| miR_519c_5p | 0.18 | 0.07, 0.49 (0.001) | 0.79 | 0.69, 0.88 (0.18) |
| | VALIDATION COHORT (n = 60) | | | |
| miRNA* | OR** | 95% CI (P) | AUC† | 95% CI (P‡) |
| miR_19a | 9.22 | 2.27, 37.43 (0.002) | 0.85 | 0.75, 0.95 (0.13) |
| miR_19b | 12.67 | 2.72, 58.98 (0.001) | 0.86 | 0.76, 0.96 (0.10) |
| miR_345 | 0.03 | 0.002, 0.37 (0.007) | 0.84 | 0.74, 0.94 (0.09) |
| miR_519c_5p | 0.06 | 0.01, 0.30 (0.001) | 0.88 | 0.80, 0.96 (0.04) |

FIG. 14

| Model* | miRNA | OR | 95% CI (P) | AUC | 95% CI (P) |
|---|---|---|---|---|---|
| 1 | miR_19a | 9.72 | 1.52, 62.10 (0.016) | 0.941 | 0.88, 1.00 (0.007) |
| | miR_345 | 0.01 | 0.00, 0.65 (0.031) | | |
| | miR_519c_5p | 0.05 | 0.01, 0.46 (0.008) | | |
| 2 | miR_19b | 12.49 | 1.64, 94.97 (0.015) | 0.939 | 0.87, 1.00 (0.009) |
| | miR_345 | 0.01 | 0.00, 0.70 (0.034) | | |
| | miR_519c_5p | 0.06 | 0.01, 0.49 (0.009) | | |
| 3 | miR_19a | 1.82 | 0.03, 115.26 (0.780) | 0.939 | 0.87, 1.00 (0.009) |
| | miR_19b | 7.14 | 0.09, 557.08 (0.376) | | |
| | miR_345 | 0.01 | 0.00, 0.70 (0.034) | | |
| | miR_519c_5p | 0.06 | 0.01, 0.50 (0.010) | | |

FIG. 15
A. DISCOVERY COHORT
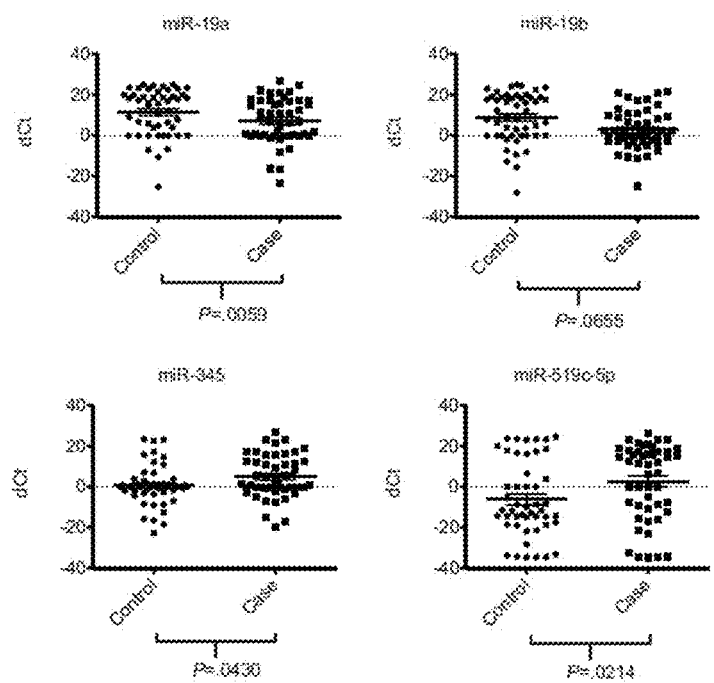
B. VALIDATION COHORT
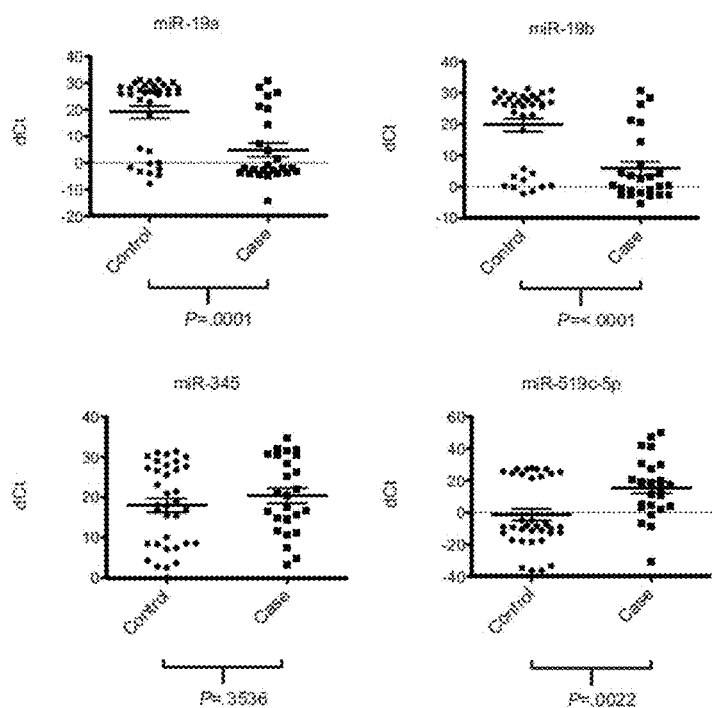

FIG. 17
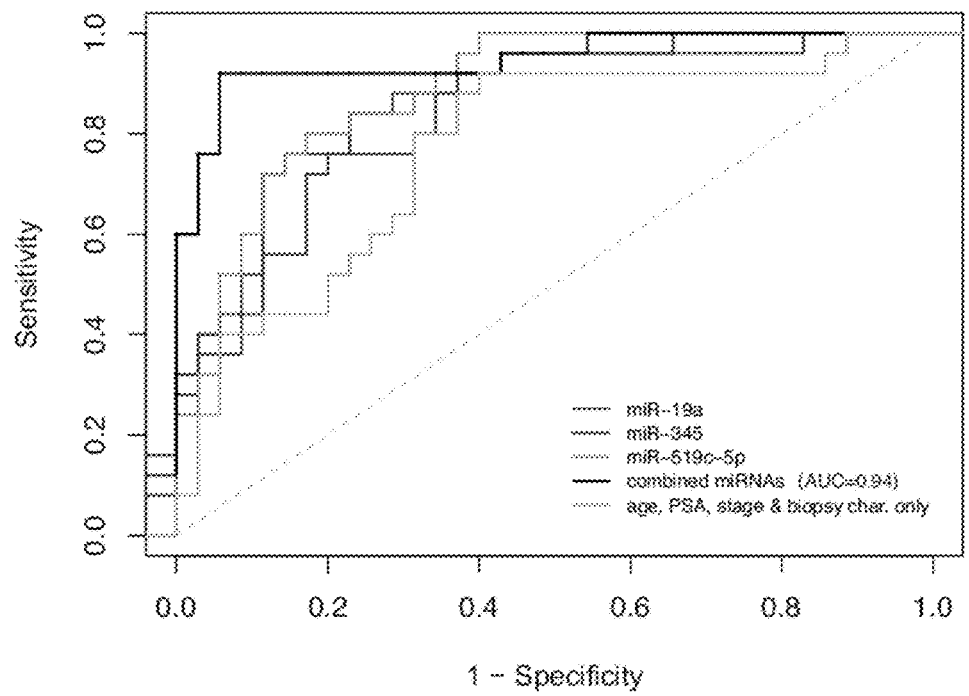
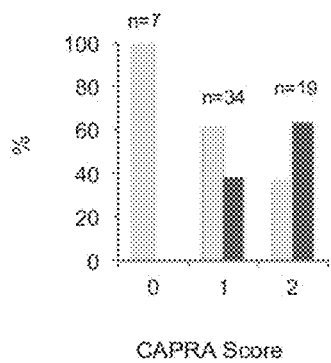
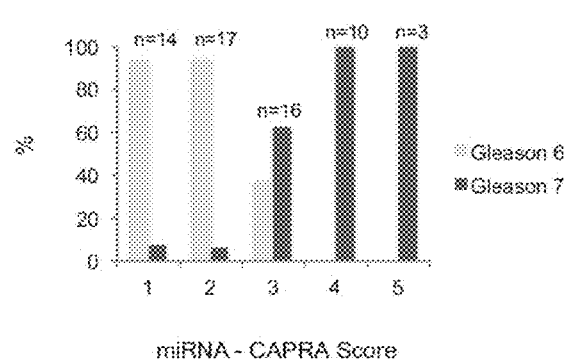

| | | | | | |
|---|---|---|---|---|---|
| hsa/mmu miR-744 | CTCAACTGGTGTCGTGGAGTCGGCAATTCAGTTGAGTGCTGTTA | 209 | ACACTCCAGCTGGGTGCGGGGCTAGGGCTA | 1155 | /56-FAM/TTCAGTTGAGTGCTGTTA/3IABLFQ/ | 2101 |
| hsa/mmu miR-760 | CTCAACTGGTGTCGTGGAGTCGGCAATTCAGTTGAGTCCCCACA | 210 | ACACTCCAGCTGGGCGGCTCTGGGTCTG | 1156 | /56-FAM/TTCAGTTGAGTCCCCACA/3IABLFQ/ | 2102 |
| hsa/mmu miR-7a | CTCAACTGGTGTCGTGGAGTCGGCAATTCAGTTGAGACAACAAA | 211 | ACACTCCAGCTGGGTGGAAGACTAGTGATT | 1157 | /56-FAM/TTCAGTTGAGACAACAAA/3IABLFQ/ | 2103 |
| hsa/mmu miR-873 | CTCAACTGGTGTCGTGGAGTCGGCAATTCAGTTGAGAGGAGACT | 212 | ACACTCCAGCTGGGGCAGGGAACTTGTGAG | 1158 | /56-FAM/TTCAGTTGAGAGGAGACT/3IABLFQ/ | 2104 |
| hsa/mmu miR-874 | CTCAACTGGTGTCGTGGAGTCGGCAATTCAGTTGAGTCGGTCCC | 213 | ACACTCCAGCTGGGCTGCCCTGGCCCGAGG | 1159 | /56-FAM/TTCAGTTGAGTCGGTCCC/3IABLFQ/ | 2105 |
| hsa/mmu miR-875-5p | CTCAACTGGTGTCGTGGAGTCGGCAATTCAGTTGAGCACCTGAT | 214 | ACACTCCAGCTGGGTATACCTCAGTTTAT | 1160 | /56-FAM/TTCAGTTGAGCACCTGAT/3IABLFQ/ | 2106 |
| hsa/mmu miR-877 | CTCAACTGGTGTCGTGGAGTCGGCAATTCAGTTGAGCCCTGCGC | 215 | ACACTCCAGCTGGGTCTTTGGTTATCTAGCT | 1161 | /56-FAM/TTCAGTTGAGCCCTGCGC/3IABLFQ/ | 2107 |
| hsa/mmu miR-9 | CTCAACTGGTGTCGTGGAGTCGGCAATTCAGTTGAGTCATACAG | 216 | ACACTCCAGCTGGGTCTTTGGTTATCTAGCT | 1162 | /56-FAM/TTCAGTTGAGTCATACAG/3IABLFQ/ | 2108 |
| hsa/mmu miR-92b | CTCAACTGGTGTCGTGGAGTCGGCAATTCAGTTGAGGGAGGCCG | 217 | ACACTCCAGCTGGGTATTGCACTCGTCCCG | 1163 | /56-FAM/TTCAGTTGAGGGAGGCCG/3IABLFQ/ | 2109 |
| hsa/mmu miR-93 | CTCAACTGGTGTCGTGGAGTCGGCAATTCAGTTGAGCTACCTGC | 218 | ACACTCCAGCTGGGCAAAGTGCTGTTCGTGC | 1164 | /56-FAM/TTCAGTTGAGCTACCTGC/3IABLFQ/ | 2110 |
| hsa/mmu miR-95 | CTCAACTGGTGTCGTGGAGTCGGCAATTCAGTTGAGAGCAAAAA | 219 | ACACTCCAGCTGGGTTTGGCACTAGCACATT | 1165 | /56-FAM/TTCAGTTGAGAGCAAAAA/3IABLFQ/ | 2111 |
| hsa/mmu miR-98 | CTCAACTGGTGTCGTGGAGTCGGCAATTCAGTTGAGAACAATAC | 220 | ACACTCCAGCTGGGTGAGGTAGTAAGTTGT | 1166 | /56-FAM/TTCAGTTGAGAACAATAC/3IABLFQ/ | 2112 |
| hsa/mmu miR-99a | CTCAACTGGTGTCGTGGAGTCGGCAATTCAGTTGAGCACAAGAT | 221 | ACACTCCAGCTGGGAACCCGTAGATCCGAT | 1167 | /56-FAM/TTCAGTTGAGCACAAGAT/3IABLFQ/ | 2113 |
| hsa/mmu miR-99b | CTCAACTGGTGTCGTGGAGTCGGCAATTCAGTTGAGCGCAAGGT | 222 | ACACTCCAGCTGGGCACCCGTAGAACCGAC | 1168 | /56-FAM/TTCAGTTGAGCGCAAGGT/3IABLFQ/ | 2114 |

| Name | Sequence 1 | # | Sequence 2 | # | Probe |
|---|---|---|---|---|---|
| hsa-miR-770-5p | CTCAACTGGTGTCGTGGAGTCGGCAATTCAGTTGAGTGAGCCCTG | 642 | ACACTCCAGCTGGGTCCAGTACCACGTGTCA | 1588 | /56-FAM/TTCAGTTGAGTGGCCCTG/3IABLFQ/ |
| hsa-miR-802 | CTCAACTGGTGTCGTGGAGTCGGCAATTCAGTTCAGTTGAGACAAGGAT | 643 | ACACTCCAGCTGGGTCCAGTAAACAAAGATTCAT | 1589 | /56-FAM/TTCAGTTGAGACAAGGAT/3IABLFQ/ |
| hsa-miR-875-3p | CTCAACTGGTGTCGTGGAGTCGGCAATTCAGTTGAGCACAACCT | 644 | ACACTCCAGCTGGGCCTGGAAACACTGAG | 1590 | /56-FAM/TTCAGTTGAGCACAACCT/3IABLFQ/ |
| hsa-miR-876-3p | CTCAACTGGTGTCGTGGAGTCGGCAATTCAGTTGAGTGAATTAC | 645 | ACACTCCAGCTGGGTGGTCGTTTACAAAGT | 1591 | /56-FAM/TTCAGTTGAGTGAATTAC/3IABLFQ/ |
| hsa-miR-876-5p | CTCAACTGGTGTCGTGGAGTCGGCAATTCAGTTGAGTGGTGATT | 646 | ACACTCCAGCTGGGTGGTGATTTCTTTGTGAA | 1592 | /56-FAM/TTCAGTTGAGTGGTGATT/3IABLFQ/ |
| hsa-miR-885-3p | CTCAACTGGTGTCGTGGAGTCGGCAATTCAGTTGAGTATCCACT | 647 | ACACTCCAGCTGGGTCAGGCAGGTATCCACT | 1593 | /56-FAM/TTCAGTTGAGTATCCACT/3IABLFQ/ |
| hsa-miR-885-5p | CTCAACTGGTGTCGTGGAGTCGGCAATTCAGTTGAGAGAGGCAG | 648 | ACACTCCAGCTGGGTCCATTACACTACCCT | 1594 | /56-FAM/TTCAGTTGAGAGAGGCAG/3IABLFQ/ |
| hsa-miR-886-3p | CTCAACTGGTGTCGTGGAGTCGGCAATTCAGTTGAGAAGGGTCA | 649 | ACACTCCAGCTGGGCGCGGTGCTTACTG | 1595 | /56-FAM/TTCAGTTGAGAAGGGTCA/3IABLFQ/ |
| hsa-miR-886-5p | CTCAACTGGTGTCGTGGAGTCGGCAATTCAGTTGAGCCGCTTGA | 650 | ACACTCCAGCTGGGCGGGTCGGAGTTAGCTC | 1596 | /56-FAM/TTCAGTTGAGCCGCTTGA/3IABLFQ/ |
| hsa-miR-887 | CTCAACTGGTGTCGTGGAGTCGGCAATTCAGTTGAGCCCTCGGGA | 651 | ACACTCCAGCTGGGGTGAACGGCGCCAATC | 1597 | /56-FAM/TTCAGTTGAGCCCTCGGGA/3IABLFQ/ |
| hsa-miR-888 | CTCAACTGGTGTCGTGGAGTCGGCAATTCAGTTGAGTGACTGAC | 652 | ACACTCCAGCTGGGTACTCAAAAAGCTGT | 1598 | /56-FAM/TTCAGTTGAGTGACTGAC/3IABLFQ/ |
| hsa-miR-889 | CTCAACTGGTGTCGTGGAGTCGGCAATTCAGTTGAGACAATGGT | 653 | ACACTCCAGCTGGGTTAATATCGGACAAC | 1599 | /56-FAM/TTCAGTTGAGACAATGGT/3IABLFQ/ |
| hsa-miR-890 | CTCAACTGGTGTCGTGGAGTCGGCAATTCAGTTGAGCAACTGAT | 654 | ACACTCCAGCTGGGTACTTGGAAAGGCAT | 1600 | /56-FAM/TTCAGTTGAGCAACTGAT/3IABLFQ/ |
| hsa-miR-891a | CTCAACTGGTGTCGTGGAGTCGGCAATTCAGTTGAGTCAGTGGC | 655 | ACACTCCAGCTGGGTGCAACGAACCTGAGC | 1601 | /56-FAM/TTCAGTTGAGTCAGTGGC/3IABLFQ/ |
| hsa-miR-891b | CTCAACTGGTGTCGTGGAGTCGGCAATTCAGTTGAGTCAATGAC | 656 | ACACTCCAGCTGGGTGCAACTTACCTGAGT | 1602 | /56-FAM/TTCAGTTGAGTCAATGAC/3IABLFQ/ |
| hsa-miR-892a | CTCAACTGGTGTCGTGGAGTCGGCAATTCAGTTGAGCTACGCAG | 657 | ACACTCCAGCTGGGCCACTGTGTCCTTCT | 1603 | /56-FAM/TTCAGTTGAGCTACGCAG/3IABLFQ/ |
| hsa-miR-892b | CTCAACTGGTGTCGTGGAGTCGGCAATTCAGTTGAGTCACCCA | 658 | ACACTCCAGCTGGGCACTGGCCTCCTTCTG | 1604 | /56-FAM/TTCAGTTGAGTCACCCA/3IABLFQ/ |
| hsa-miR-920 | CTCAACTGGTGTCGTGGAGTCGGCAATTCAGTTGAGTACTGCTT | 659 | ACACTCCAGCTGGGGGGGAGCTGTGAA | 1605 | /56-FAM/TTCAGTTGAGTACTGCTT/3IABLFQ/ |
| hsa-miR-921 | CTCAACTGGTGTCGTGGAGTCGGCAATTCAGTTGAGGAATCCTG | 660 | ACACTCCAGCTGGGCTAGTGAGGGACAAGAACCA | 1606 | /56-FAM/TTCAGTTGAGGAATCCTG/3IABLFQ/ |
| hsa-miR-922 | CTCAACTGGTGTCGTGGAGTCGGCAATTCAGTTGAGGACGTAGT | 661 | ACACTCCAGCTGGGCAGCAGCAGAATAGGAC | 1607 | /56-FAM/TTCAGTTGAGGACGTAGT/3IABLFQ/ |
| hsa-miR-923 | CTCAACTGGTGTCGTGGAGTCGGCAATTCAGTTGAGAGTTCTT | 662 | ACACTCCAGCTGGGGTACGCGGAGGAAAA | 1608 | /56-FAM/TTCAGTTGAGAGTTCTT/3IABLFQ/ |
| hsa-miR-924 | CTCAACTGGTGTCGTGGAGTCGGCAATTCAGTTGAGGCAAGACA | 663 | ACACTCCAGCTGGGAGAGTCTTGTGATG | 1609 | /56-FAM/TTCAGTTGAGGCAAGACA/3IABLFQ/ |
| hsa-miR-92b | CTCAACTGGTGTCGTGGAGTCGGCAATTCAGTTGAGACAGGCCG | 664 | ACACTCCAGCTGGGTATTGCACTTGTCCCG | 1610 | /56-FAM/TTCAGTTGAGACAGGCCG/3IABLFQ/ |
| hsa-miR-933 | CTCAACTGGTGTCGTGGAGTCGGCAATTCAGTTGAGGGGAGAGG | 665 | ACACTCCAGCTGGGTGTGCCAGGAGACC | 1611 | /56-FAM/TTCAGTTGAGGGGAGAGG/3IABLFQ/ |
| hsa-miR-934 | CTCAACTGGTGTCGTGGAGTCGGCAATTCAGTTGAGCCAGTGTC | 666 | ACACTCCAGCTGGGTGTCTACTACTGGAGA | 1612 | /56-FAM/TTCAGTTGAGCCAGTGTC/3IABLFQ/ |
| hsa-miR-935 | CTCAACTGGTGTCGTGGAGTCGGCAATTCAGTTGAGGCGGTAGC | 667 | ACACTCCAGCTGGGCCAGTTACCGCTTCCGC | 1613 | /56-FAM/TTCAGTTGAGGCGGTAGC/3IABLFQ/ |
| hsa-miR-936 | CTCAACTGGTGTCGTGGAGTCGGCAATTCAGTTGAGCTGCGATT | 668 | ACACTCCAGCTGGGACAGTAGAGGGAGGAA | 1614 | /56-FAM/TTCAGTTGAGCTGCGATT/3IABLFQ/ |
| hsa-miR-937 | CTCAACTGGTGTCGTGGAGTCGGCAATTCAGTTGAGACTGGGTT | 669 | ACACTCCAGCTGGGATCCGCGCTCTGACTC | 1615 | /56-FAM/TTCAGTTGAGACTGGGTT/3IABLFQ/ |
| hsa-miR-938 | CTCAACTGGTGTCGTGGAGTCGGCAATTCAGTTGAGAACGTGAA | 670 | ACACTCCAGCTGGGTGCCCTTAAAGCTGAA | 1616 | /56-FAM/TTCAGTTGAGAACGTGAA/3IABLFQ/ |
| hsa-miR-939 | CTCAACTGGTGTCGTGGAGTCGGCAATTCAGTTGAGCACCCCA | 671 | ACACTCCAGCTGGGTGGGGAGCTGAGGCTCTG | 1617 | /56-FAM/TTCAGTTGAGCACCCCA/3IABLFQ/ |
| hsa-miR-940 | CTCAACTGGTGTCGTGGAGTCGGCAATTCAGTTGAGGGGGAGCG | 672 | ACACTCCAGCTGGGAAGGCAGGGGCCCCCG | 1618 | /56-FAM/TTCAGTTGAGGGGGAGCG/3IABLFQ/ |
| hsa-miR-941 | CTCAACTGGTGTCGTGGAGTCGGCAATTCAGTTGAGCACATGT | 673 | ACACTCCAGCTGGGCACCCGGCTGTGTGCAC | 1619 | /56-FAM/TTCAGTTGAGCACATGT/3IABLFQ/ |
| hsa-miR-942 | CTCAACTGGTGTCGTGGAGTCGGCAATTCAGTTGAGCACATGGC | 674 | ACACTCCAGCTGGGTCTTCTCTGTTTTGGC | 1620 | /56-FAM/TTCAGTTGAGCACATGGC/3IABLFQ/ |
| hsa-miR-943 | CTCAACTGGTGTCGTGGAGTCGGCAATTCAGTTGAGCTGGAGGA | 675 | ACACTCCAGCTGGGCTGACTGTTGCCGTC | 1621 | /56-FAM/TTCAGTTGAGCTGGAGGA/3IABLFQ/ |
| hsa-miR-944 | CTCAACTGGTGTCGTGGAGTCGGCAATTCAGTTGAGCTCATCCG | 676 | ACACTCCAGCTGGGAAATATTGTACATCG | 1622 | /56-FAM/TTCAGTTGAGCTCATCCG/3IABLFQ/ |
| hsa-miR-95 | CTCAACTGGTGTCGTGGAGTCGGCAATTCAGTTGAGTGCTCAAT | 677 | ACACTCCAGCTGGGTTCAACGGGTATTTAT | 1623 | /56-FAM/TTCAGTTGAGTGCTCAAT/3IABLFQ/ |

| Name | Sequence | SEQ ID | Probe | SEQ ID |
|---|---|---|---|---|
| mmu miR-879 | CTCAACTGGTGTCGTGGAGTCGGCAATTCAGTTGAGGGCTTAGA | 938 | ACACTCCAGCTGGGAGACGGCTTATAGCTTC | 1884 | /56-FAM/TTCAGTTGAGGGCTTAGA/3IABLFQ/ | 2830 |
| mmu miR-880 | CTCAACTGGTGTCGTGGAGTCGGCAATTCAGTTGAGTCTACTCA | 939 | ACACTCCAGCTGGGTACTCCATCCTCTCTG | 1885 | /56-FAM/TTCAGTTGAGTCTACTCA/3IABLFQ/ | 2831 |
| mmu miR-881 | CTCAACTGGTGTCGTGGAGTCGGCAATTCAGTTGAGTCTATTCA | 940 | ACACTCCAGCTGGGAACTGTGTCTTTTCTG | 1886 | /56-FAM/TTCAGTTGAGTCTATTCA/3IABLFQ/ | 2832 |
| mmu miR-882 | CTCAACTGGTGTCGTGGAGTCGGCAATTCAGTTGAGACTAATGC | 941 | ACACTCCAGCTGGGAGGAGAGAGTTAGCUGC | 1887 | /56-FAM/TTCAGTTGAGACTAATGC/3IABLFQ/ | 2833 |
| mmu miR-883a-3p | CTCAACTGGTGTCGTGGAGTCGGCAATTCAGTTGAGATACTGAG | 942 | ACACTCCAGCTGGGTAACTGCAACAGCTCT | 1888 | /56-FAM/TTCAGTTGAGATACTGAG/3IABLFQ/ | 2834 |
| mmu miR-883a-5p | CTCAACTGGTGTCGTGGAGTCGGCAATTCAGTTGAGGTAACTGC | 943 | ACACTCCAGCTGGGTGCTGAGAGAAGTAGC | 1889 | /56-FAM/TTCAGTTGAGGTAACTGC/3IABLFQ/ | 2835 |
| mmu miR-883b-3p | CTCAACTGGTGTCGTGGAGTCGGCAATTCAGTTGAGATACTGAG | 944 | ACACTCCAGCTGGGTAACTGCAACATCTCT | 1890 | /56-FAM/TTCAGTTGAGATACTGAG/3IABLFQ/ | 2836 |
| mmu miR-883b-5p | CTCAACTGGTGTCGTGGAGTCGGCAATTCAGTTGAGTGACTGCT | 945 | ACACTCCAGCTGGGTACTGAGAATGGGTAG | 1891 | /56-FAM/TTCAGTTGAGTGACTGCT/3IABLFQ/ | 2837 |
| mmu miR-92a | CTCAACTGGTGTCGTGGAGTCGGCAATTCAGTTGAGCAGGCCGG | 946 | ACACTCCAGCTGGGTATTGCACTTGTCCC | 1892 | /56-FAM/TTCAGTTGAGCAGGCCGG/3IABLFQ/ | 2838 |

METHODS AND SYSTEMS FOR
DETERMINING A LIKELIHOOD OF
ADVERSE PROSTATE CANCER
PATHOLOGY

CROSS-REFERENCE TO RELATED APPLICATIONS

This application is a continuation of international application serial no. PCT/US2013/068126, filed Nov. 1, 2013, which application claims priority to the filing date of U.S. Provisional Application Ser. No. 61/721,699 filed Nov. 2, 2012, the disclosure of which is herein incorporated by reference in its entirety.

STATEMENT REGARDING FEDERALLY SPONSORED RESEARCH

This invention was made with government support under Grant No. CA161615 awarded by the National Institutes of Health. The government has certain rights in the invention.

INTRODUCTION

Prostate cancer is the fifth most common malignancy in the world, with over 200,000 new cases diagnosed in North America annually. While screening has decreased prostate cancer mortality rates, it has done so at the risk of detecting early stage/grade prostate cancer that might not affect a patient's life if untreated. Treating those with low risk disease results in unnecessary morbidities associated with radical interventions such as surgery or radiation.

Active surveillance (AS) is a strategy developed to reduce the treatment of patients with low risk prostate cancer. Such patients are often monitored with physical exams, selective imaging, PSA assessments, and/or repeat biopsies. Treatment is then offered to those with signs of progression. Although AS is a viable option for men with low-risk prostate cancer, there are considerable misclassification rates when identifying candidates for AS. Accordingly, nomograms have been developed to predict post-surgical pathology in low-risk patients utilizing clinical characteristics such as age, PSA, and stage. However, existing approaches demonstrate a low accuracy rate, complicating decision-making. Further, due to the limitations of PSA as a surrogate for disease progression and the significant concerns about biopsy sampling errors, both patients and clinicians worry that delayed treatment compromises the ability to cure disease.

SUMMARY

The present disclosure provides methods that find use in determining a likelihood of adverse prostate cancer pathology in a subject. The methods generally involve detection of one or more diagnostic microRNAs (miRNAs), such as mir-19a, mir-19b, mir-519c-5p, and/or mir-345. The detection of one or more (e.g., a combination) of such diagnostic miRNAs can be used to determine a likelihood of adverse prostate cancer pathology in a subject. The methods of the present disclosure also find use in facilitating treatment decisions for a subject. Also provided are devices, systems, and kits that may be used in practicing methods of the present disclosure.

The present disclosure provides methods of determining a likelihood of adverse prostate cancer pathology in a subject, the methods including determining an amount of at least one diagnostic miRNA in a biological sample from the subject, comparing the amount of the at least one diagnostic miRNA with a reference amount, and generating a report indicating a likelihood of adverse prostate cancer pathology in the subject based on results of said comparing the amount of the at least one diagnostic miRNA with the reference amount. The biological sample used in the methods of the present disclosure can be blood or blood product, e.g., serum or plasma. The methods may optionally include obtaining the biological sample from the subject.

The means of determining an amount of a diagnostic miRNA in a biological sample may vary. In some aspects, determining the amount of a diagnostic miRNA involves performing quantitative real-time PCR, such as multiplexed quantitative real-time PCR. The amount of the diagnostic miRNA may be compared to a reference amount calculated in a variety of different ways. In some aspects, the reference amount is a control amount of the diagnostic miRNA. In other aspects, the reference amount may be calculated from cycle threshold (Ct) values of a plurality of reference miRNAs from the biological sample, such as by computing a median Ct value from the plurality. Reference miRNAs of interest include, but are not limited to, mir-17, mir-20a, mir-92a, mir-106a, mir-93, mir-25, let-7b, mir-24, mir-939, mir-1234, mir-522, mir-525-5p, mir-660, mir-941, mir-1274a, mir-1274b, mir-302f, mir-34c-3p, mir-663, mir-197, mir-223, mir-297, mir-346, mir-484, mir-486, mir-584, mir-638, mir-629, mir-720, mir-942, mir-1208, and mir-1243. Further, in some aspects a reference amount may be calculated based upon a biomolecule that is not a miRNA, such as a polypeptide (e.g., a protein or peptide), long non-coding RNA molecule, small RNA(s), spiked-in RNAs, and the like.

The methods may optionally indicate a likelihood of adverse prostate cancer pathology in a subject by taking into account one or more additional risk factors. Risk factors of interest include, but are not limited to, factors that may be assessed without biopsying the subject, such as the subject's age, prostate-specific antigen (PSA) level, and/or clinical stage. In certain aspects, the methods include measuring the subject's PSA level and/or determining the subject's clinical stage. Risk factors of interest further include, but are not limited to, factors that may be assessed from a biopsy (e.g., a biopsy of the subject's prostate), including the subject's Gleason score, the percentage of biopsy cores positive, the fraction of the biopsy that is positive, or any combination thereof. In certain aspects, the methods include biopsying the subject's prostate.

The methods of the present disclosure can include selecting a therapy for the subject based on the likelihood of adverse prostate cancer pathology, where in some embodiments the treatment recommendation is active surveillance, watchful waiting, or a similar non-invasive approach. The methods of the present disclosure can include administering a therapy for the subject based on the likelihood of adverse prostate cancer pathology. Where the subject is undergoing therapy, the methods of the present disclosure can include modifying therapy for the subject based on the results of the assay(s).

The methods of the present disclosure can involve inputting the amount of one or more diagnostic miRNAs into a computer programmed to execute an algorithm to perform the comparing step, wherein said inputting generates a result for a report. The report can be displayed to an output device, e.g., at a location remote to the computer.

The present disclosure also provides devices for determining a likelihood of adverse prostate cancer pathology in a subject. The devices include an analyzing unit comprising a detection agent for one or more diagnostic miRNAs, where the analyzing unit is configured for determining an amount of the diagnostic miRNA(s) in a biological sample detected by the detection agent; and an evaluation unit comprising a processor programmed to compare the determined amount(s) obtained from the analyzing unit with a reference amount; and calculate a likelihood of adverse prostate cancer pathology in the subject, based on results of the comparing the determined amount(s) obtained from the analyzing unit with the reference amount. In certain aspects, the processor of the evaluation unit is programmed to calculate a likelihood of adverse prostate cancer pathology in the subject based on one or more additional risk factors, such as the subject's age, PSA level, clinical stage, Gleason score, percentage of biopsy cores positive, the fraction of the biopsy that is positive, and the like. The device may optionally include a display comprising a user interface configured to receive user input (e.g., input as to the subject's age, PSA level, and the like) and provide the input to the processor.

Also provided by the present disclosure are kits, such as kits that include a detection agent for one or more diagnostic miRNA molecules, and a device for determining a likelihood of adverse prostate cancer pathology in a subject (e.g., a device as described above).

The present disclosure also provides computer systems for determining a likelihood of adverse prostate cancer pathology in a subject. The computer systems include a processor and memory operably coupled to the processor, where the memory programs the processor to receive assay data including an amount of at least one diagnostic miRNA in a biological sample from a subject; compare the amount received with a reference amount; and calculate a likelihood of adverse prostate cancer pathology in the subject, based on results of said comparing the determined amounts obtained from the analyzing unit with the reference amount. In certain aspects, the system calculates a likelihood of adverse prostate cancer pathology in the subject based on one or more additional risk factors, such as the subject's age, PSA level, etc.

These and other features will be apparent to the ordinarily skilled artisan upon reviewing the present disclosure.

BRIEF DESCRIPTION OF THE DRAWINGS

The invention may be best understood from the following detailed description when read in conjunction with the accompanying drawings. Included in the drawings are the following figures:

FIG. 1 is a schematic of a design of a first study. Patients met the UCSF low-risk criteria for AS including biopsy Gleason 2-6 (no pattern 4 or 5), PSA less than 10 ng/ml, less than 33% of biopsy cores involved, less than 50% involvement in any single core, and clinical T1-T2 stage disease. All selected patients chose to undergo immediate radical prostatectomy. A Gleason score of 7 of higher was used to define adverse prostate cancer pathology. The discovery cohort consisted of 48 patients with a post-surgical specimen Gleason score ≥7 (case group) and 48 patients with a post-surgical specimen Gleason score of 6 (control group). A validation cohort consisted of 46 patients in case and 50 patients in control group.

FIG. 2 is a table listing patient characteristics of the discovery and validation cohorts. In the discovery cohort, there were no statistically significant differences in race, PSA, or clinical stage between the case and control groups, though the case group did have a significantly higher age than the control group (p=0.009). Similar to the discovery cohort, there were no statistically significant differences in race, PSA, or clinical stage between cases and controls in the validation cohort, though the case group was significantly older than the control group (p=0.002).

FIG. 3 is a table listing miRNAs for which detectable Ct values were demonstrated in at least 30% of the patients according to multiplex qRT-PCR on a microfluidics platform. Detectable Ct values were demonstrated for 36 of the 672 miRNAs evaluated in serum of 96 patients with pre-surgical low risk disease (PSA<10, Gleason<7 with no 4+2, clinical stage <T3), but chose surgery over AS (see FIGS. 1-2).

FIG. 8, Panels A-B show CAPRA and modified CAPRA scores by case status in the validation cohort. Panel A: distribution of CAPRA scores for patients in the validation cohort. Panel B: modified CAPRA scores were produced by adding one point to the score for each positive miRNA (considering only mir-19a, mir-19b, and mir-519c-5p), where positivity is detection of a value exceeding the median detectable value. The resulting score (miRNA+CAPRA) displayed a significant increasing linear trend (p<0.001) in outcome risk, with 100% of the 12 individuals scored at the highest level (5) classified as cases.

FIG. 12 is a table showing miRNAs consistently detected in the serum from the discovery cohort.

FIG. 13 is a table showing summaries of logistic regression models for individual miRNAs in the discovery and validation cohorts accounting for age, PSA, stage and biopsy characteristics. *miRNAs were represented in models as binary indicators, with cut-offs selected using a classification tree. **Estimated odds ratio from a logistic regression also controlling for age, PSA, stage and degree of biopsy involvement. † Estimated area under the ROC curve from a logistic regression also controlling for age, PSA, stage and degree of biopsy involvement. ‡ P-value comparing AUC for model including for miRNA, to model including only age, PSA, stage and degree of biopsy involvement.

FIG. 14 is a table showing summaries of logistic regression models for different combinations of miRNAs in validation cohort accounting for age, PSA, stage and biopsy characteristics.

FIG. 15 shows distribution plots for serum miR-19b, miR-19a, miR-345, and miR-519c-5p delta Ct values in case versus control for a) discovery cohort, b) validation cohort. Delta Ct represents difference between Ct of individual miRNA and median Ct value among detected miRNAs within each patient. Horizontal bars represent mean+/−SEM.

FIG. 17 shows prediction models for miRNAs. Panel A: ROC curves for age, PSA, and stage plus/minus individual miRNAs or combination of all 3 miRNAs; Panel B: Percentage of patients with either Gleason 6 (light grey) or Gleason 7 (dark grey) post-surgery relative to pre-surgery CAPRA score; Panel C: Same as Panel B, but with addition of miRNAs. A value of 1 is given for each positive miRNA and added to CAPRA score. CAPRA nomogram combines the following variables: Age at diagnosis, PSA at diagnosis, Gleason score of pre-surgical biopsy, Clinical stage, and Percent of involved biopsies.

FIGS. 19A-C are tables listing stem-loop primers, forward primers, and Taqman probes.

DETAILED DESCRIPTION

Figure 4:
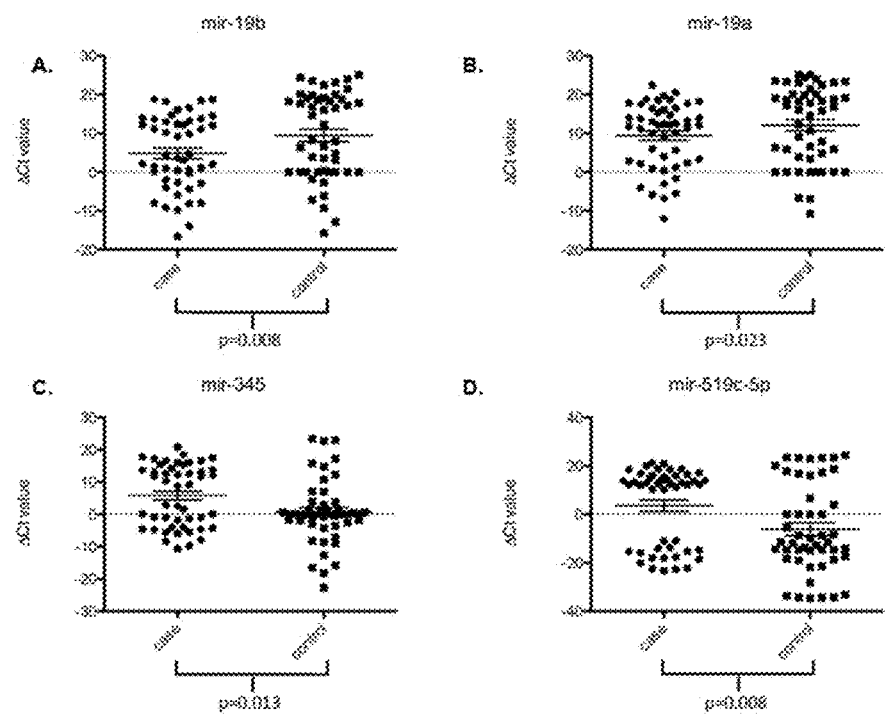
FIG. 4, Panels A-D depict the four detected miRNAs that demonstrated differences in serum levels between the cases and controls. Mir-19b (Panel A) and mir-19a (Panel B) had significantly lower ΔCt values in the case group when compared to the controls (p=0.008 and p=0.023, respectively), showing higher serum expression in the case group. Conversely, mir-345 (Panel C) and mir-519c-5p (Panel D) had significantly higher ΔCt values in the case group when compared to the controls (p=0.013 and p=0.008, respectively), showing lower serum expression in the case group.

Before the present invention is described in greater detail, it is to be understood that this invention is not limited to particular embodiments described, as such may, of course, vary. It is also to be understood that the terminology used herein is for the purpose of describing particular embodiments only, and is not intended to be limiting, since the scope of the present invention will be limited only by the appended claims.

Where a range of values is provided, it is understood that each intervening value, to the tenth of the unit of the lower limit unless the context clearly dictates otherwise, between the upper and lower limits of that range is also specifically disclosed. Each smaller range between any stated value or intervening value in a stated range and any other stated or intervening value in that stated range is encompassed within the invention. The upper and lower limits of these smaller ranges may independently be included or excluded in the range, and each range where either, neither or both limits are included in the smaller ranges is also encompassed within the invention, subject to any specifically excluded limit in the stated range. Where the stated range includes one or both of the limits, ranges excluding either or both of those included limits are also included in the invention.

Unless defined otherwise, all technical and scientific terms used herein have the same meaning as commonly understood by one of ordinary skill in the art to which this invention belongs. Although any methods and materials similar or equivalent to those described herein can be used in the practice or testing of the present invention, some potential and exemplary methods and materials may now be described. Any and all publications mentioned herein are incorporated herein by reference to disclose and describe the methods and/or materials in connection with which the publications are cited. It is understood that the present disclosure supersedes any disclosure of an incorporated publication to the extent there is a contradiction.

It must be noted that as used herein and in the appended claims, the singular forms "a", "an", and "the" include plural referents unless the context clearly dictates otherwise. Thus, for example, reference to "a biological sample" includes a plurality of such biological samples and reference to "the processor" includes reference to one or more processors, and so forth.

It is further noted that the claims may be drafted to exclude any element which may be optional. As such, this statement is intended to serve as antecedent basis for use of such exclusive terminology as "solely", "only" and the like in connection with the recitation of claim elements, or the use of a "negative" limitation.

The publications discussed herein are provided solely for their disclosure prior to the filing date of the present application. Nothing herein is to be construed as an admission that the present invention is not entitled to antedate such publication by virtue of prior invention. Further, the dates of publication provided may be different from the actual publication dates which may need to be independently confirmed. To the extent such publications may set out definitions of a term that conflict with the explicit or implicit definition of the present disclosure, the definition of the present disclosure controls.

As will be apparent to those of skill in the art upon reading this disclosure, each of the individual embodiments described and illustrated herein has discrete components and features which may be readily separated from or combined with the features of any of the other several embodiments without departing from the scope or spirit of the present invention. Any recited method can be carried out in the order of events recited or in any other order which is logically possible.

Definitions

The term "prostate cancer" is known in the art, and refers to a proliferative lesion or abnormality of the prostate. Accordingly, the term encompasses benign lesions, premalignant lesions, malignant lesions as well as solid tumors and metastatic disease (both locally metastatic and more widely metastatic).

The terms "staging prostate cancer" and "clinical stage" are used to differentiate between various stages of prostate cancer. The general classification of prostate tumor stages is well-known to the skilled artisan. In brief, the most commonly used staging method is the Tumor, Nodes, Metastasis (TNM) system, which recognizes four stages of local tumor growth, from T1 (incidental) to T4 (invasion of neighboring organs). Each stage describes the state of pathological development of the tumor. T1 represents an 'incidental' state, where the tumor is detected by chance following transurethral resection or by biopsy following PSA testing. At this stage, the tumor will be undetectable by palpation (DRE) or ultrasound, but may be diagnosed by the method of the present invention. T4 represents advanced disease, where the tumor has invaded neighboring organs. The nodal stage (N0-N1) and the metastatic stage (M0-M1C) reflect the clinical spread of the disease to lymph nodes and distant sites (metastasis), respectively.

Grading systems can assess the degree of cell anaplasia (variation in size, shape and staining properties) and differentiation (how well differentiated the cells are) in the tumor. The Gleason grading system is based on the extent to which the tumor cells are arranged into recognizably glandular structures and the level of cell differentiation. The Gleason system identifies more than five levels of increasing disease aggressiveness, with Grade 1 being the least aggressive and over Grade 5 being the most aggressive cancer. The Gleason system is described in, e.g., Gleason, D. F. (1977) *Urologic Pathology: The Prostate*. Philadelphia: Lea and Febiger. pp. 171-198; the disclosure of which is incorporated herein by reference.

In certain embodiments of the method of the present invention, it is differentiated between high risk, an intermediate risk and a low risk. A subject at "low risk" is generally a subject suffering from prostate cancer with a Gleason score of 6 or lower than 6. "Low risk" subjects may include those with Gleason 2-6 (no pattern 4 or 5), PSA less than 10 ng/ml, less than 33% of biopsy cores involved, less than 50% involvement in any single core, and clinical T1-T2 stage disease. A subject being at "intermediate risk" in the context of the method of the present invention relates to subject suffering from prostate cancer with a Gleason score of 7. A Gleason score of 7 is associated with an increased risk of disease-specific mortality, and suggests a risk of clinical progression. A subject being at "high risk" in the context of the method of the present invention relates to subject suffering from prostate cancer with a Gleason score of 8 or larger than 8.

The terms "adverse pathology" with reference to a subject having, at risk of having or suspected of having prostate cancer and "adverse prostate cancer pathology" denote a Gleason score of 7 or higher and/or any pattern 4 or higher. Such a Gleason score is associated with an increased risk of prostate cancer-specific mortality, as described in, e.g., Albertsen P C, et al. (2005) *JAMA* 293:2095-2101; the disclosure of which is incorporated herein by reference.

A "biomarker" or "marker" as used herein generally refers to an organic biomolecule (e.g., a microRNA) which is differentially present in a sample taken from a subject of one phenotypic status (e.g., having a disease) as compared with another phenotypic status (e.g., not having the disease or having a different disease). A biomarker is differentially present between different phenotypic statuses if the mean or median level of the biomarker in a first phenotypic status relative to a second phenotypic status is calculated to represent statistically significant differences. Common tests for statistical significance include, among others, t-test, ANOVA, Kruskal-Wallis, Wilcoxon, Mann-Whitney and odds ratio. Biomarkers, alone or in combination, provide measures of relative likelihood that a subject belongs to a phenotypic status of interest. As such, biomarkers can find use as markers for, for example, disease (diagnostics), therapeutic effectiveness of a drug (theranostics), and the like. Biomarkers are thus analytes in assays that facilitate diagnosis, theranostics, and the like.

The terms "microRNA" and "miRNA" are used in accord with their ordinary usage in the art. Generally speaking, miRNA are short (e.g., about 18-24 nucleotides in length), non-coding RNAs, which regulate gene expression post-transcriptionally by destabilizing messenger RNAs (mRNA) and/or inhibiting their translation. Canonical miRNAs derive from longer polymerase II transcripts, called pri-miRNAs. A complex consisting of the proteins DGCR8 and Drosha process the pri-miRNAs to pre-miRNAs, which are then exported to the cytoplasm and cleaved by the protein Dicer to mature miRNAs. Exceptions to this processing include non-canonical miRNAs that bypass DGCR8/Drosha, while still being processed by Dicer. Knockout models of Dgcr8 and Dicer have been developed that remove only canonical miRNAs or both canonical and non-canonical miRNAs, respectively.

The term "diagnostic miRNA" refers to mir-19a, mir-19b, mir-519c-5p, and/or miR-345. A diagnostic miRNA is a biomarker. Accordingly, a diagnostic miRNA may be differentially present in a sample taken from a subject of one phenotypic status (e.g., having prostate cancer) as compared with another phenotypic status (e.g., not having the disease or having a different disease). Further, a diagnostic miRNA may be differentially present in a sample taken from a subject having a certain risk level of a disease (e.g., a patient with low risk prostate cancer, and/or a patient without adverse prostate cancer pathology) as compared with another phenotypic status (e.g., a patient with intermediate- or high-risk prostate cancer, and/or a patient with adverse prostate cancer pathology).

In contrast, term "reference miRNA" is used to refer to a miRNA present in a sample that is not a diagnostic miRNA. As such, one or more reference miRNA(s) may be used to establish a reference amount against which an amount of a diagnostic miRNA may be compared, as described more fully herein. Examples of reference miRNAs of interest include, but are not limited to, mir-17, mir-20a, mir-92a, mir-106a, mir-93, mir-25, let-7b, mir-24, mir-939, mir-1234, mir-522, mir-525-5p, mir-660, mir-941, mir-1274a, mir-1274b, mir-302f, mir-34c-3p, mir-663, mir-197, mir-223, mir-297, mir-346, mir-484, mir-486, mir-584, mir-638, mir-629, mir-720, mir-942, mir-1208, and mir-1243.

The terms "individual," "subject," and "patient," used interchangeably herein, refer to a male human.

The term "healthy individual" in the context of the methods of the present disclosure refers to an individual who is unaffected by a detectable illness, particularly prostate cancer.

A "biological sample" encompasses a variety of sample types obtained from an individual. The definition encompasses biological fluids (e.g., blood (including blood fractions (e.g., serum, plasma)); and other liquid samples of biological origin (e.g., saliva, urine, bile fluid), as well as solid tissue samples in the form of a liver biopsy specimen. "Blood sample" refers to a biological sample, which is obtained from blood of a subject, and includes whole blood and blood fractions (e.g., plasma or serum) suitable for analysis in the present methods. In general, separation of cellular components and non-cellular components in a blood sample (e.g., by centrifugation) without coagulation provides a blood plasma sample, while such separation of coagulated (clotted) blood provides a blood serum sample. Examples of biological samples of blood include peripheral blood or samples derived from peripheral blood. The definition also includes samples that have been manipulated after their procurement, such as by treatment with reagents, solubilization, or enrichment for certain components, such as one or more polypeptides to be assayed. For example, a biological sample (e.g., blood) can be enriched for a fraction containing an analyte(s) of interest.

"Isolated" refers to an entity of interest that is in an environment different from that in which the compound may naturally occur. "Isolated" is meant to include compounds that are within samples that are substantially enriched for the compound of interest and/or in which the compound of interest is partially or substantially purified.

By "purified" is meant a compound of interest (e.g., an RNA, DNA or polypeptide) has been separated from components that accompany it in nature. "Purified" can also be used to refer to a compound of interest separated from components that can accompany it during manufacture (e.g., in chemical synthesis). In some embodiments, a compound is substantially pure when it is at least 50% to 60%, by weight, free from organic molecules with which it is naturally associated or with which it is associated during manufacture. In some embodiments, the preparation is at least 75%, at least 90%, at least 95%, or at least 99%, by weight, of the compound of interest. A substantially pure compound can be obtained, for example, by extraction from a natural source (e.g., bacteria), by chemically synthesizing a compound, or by a combination of purification and chemical modification. A substantially pure compound can also be obtained by, for example, enriching a sample that contains the compound. A substantially pure compound can also be obtained by recombinant or chemical synthetic production. Purity can be measured by any appropriate method, e.g., chromatography, mass spectroscopy, high performance liquid chromatography analysis, etc.

As used herein, the terms "determining", "assessing", "assaying", "measuring" and "detecting" refer to both quantitative and semi-quantitative determinations and as such, the term "determining" is used interchangeably herein with "assaying," "measuring," and the like. Where a quantitative determination is intended, the phrase "determining an amount" of an analyte and the like is used. Where either a quantitative and semi-quantitative determination is intended, the phrase "determining a level" of an analyte or "detecting" an analyte is used.

"Quantitative" assays in general provide information on the amount of an analyte in a sample relative to a reference (control), and are usually reported numerically, where a "zero" value can be assigned where the analyte is below the limit of detection. "Semi-quantitative" assays involve presentation of a numeric representation of the amount of the analyte in the specimen that is relative to a reference (e.g., a threshold, e.g., normal threshold or an abnormal threshold), where a "zero" value can be assigned where the analyte is below the limit of detection. In general, semi-quantitative results are compared against an accompanying reference interval to provide a qualitative interpretation of the result.

"Sensitivity" refers to the fraction of people with the disease or disease risk level (e.g., low risk prostate cancer) that a test correctly identifies as positive. "Specificity" refers to the fraction of people without the disease or disease risk level that the test correctly identifies as negative. The fractions with respect to sensitivity and/or specificity may be presented as a percentage. Where expressed as percentages, specificity can be calculated as by subtracting the sensitivity value for incorrect diagnosis from 100.

The term "primer" may refer to more than one primer and refers to an oligonucleotide, whether occurring naturally, as in a purified restriction digest, or produced synthetically, which is capable of acting as a point of initiation of synthesis along a complementary strand when placed under conditions in which synthesis of a primer extension product which is complementary to a nucleic acid strand is catalyzed. Such conditions include the presence of four different deoxyribonucleoside triphosphates and a polymerization-inducing agent such as DNA polymerase or reverse transcriptase, in a suitable buffer ("buffer" includes substituents which are cofactors, or which affect pH, ionic strength, etc.), and at a suitable temperature. The primer is preferably single-stranded for maximum efficiency in amplification.

The complement of a nucleic acid sequence as used herein refers to an oligonucleotide which, when aligned with the nucleic acid sequence such that the 5' end of one sequence is paired with the 3' end of the other, is in "antiparallel association." Complementarity need not be perfect; stable duplexes may contain mismatched base pairs or unmatched bases. Those skilled in the art of nucleic acid technology can determine duplex stability empirically considering a number of variables including, for example, the length of the oligonucleotide, percent concentration of cytosine and guanine bases in the oligonucleotide, ionic strength, and incidence of mismatched base pairs.

The terms "treatment," "treating," and the like, refer to obtaining a desired pharmacologic and/or physiologic effect. The effect may be prophylactic in terms of completely or partially preventing a disease or symptom thereof and/or may be therapeutic in terms of a partial or complete cure for a disease and/or adverse effect attributable to the disease. "Treatment," as used herein, covers any treatment of a disease in a mammal, particularly in a human, and includes: (a) preventing the disease from occurring in a subject which may be predisposed to the disease but has not yet been diagnosed as having it; (b) inhibiting the disease, i.e., arresting its development; and (c) relieving the disease, i.e., causing regression of the disease. Specific prostate cancer therapies of interest include, but are not limited to, active surveillance, surgery, irradiation, systemic chemotherapy, and the like. Suitable prostate cancer therapies are known in the art and described in, e.g., Suardi N, et al. (2008) *Cancer* 113:2068-2072; Heidenreich A, et al. (2008) *Eur Urol* 53:68-80; and in NCCN Clinical Practice Guidelines in Oncology Prostate Cancer, Version 1.2008; the disclosures of which are incorporated herein by reference.

Methods of Determining a Likelihood of Adverse Prostate Cancer Pathology

As summarized above, aspects of the present disclosure include methods for determining a likelihood of adverse prostate cancer pathology in a subject. Such a determination of the likelihood of adverse prostate cancer pathology may include computing a likelihood of adverse prostate cancer pathology in the subject so as to differentiate the subject from a healthy individual. A determination of the likelihood of adverse prostate cancer pathology can involve differentiating the subject from an individual with adverse prostate cancer pathology.

In general, the methods involve determining an amount of at least one diagnostic miRNA in a biological sample from the subject, comparing the amount of the at least one diagnostic miRNA with a reference amount, and generating a report indicating a likelihood of adverse prostate cancer pathology in the subject based on results of said comparing the amount of the at least one diagnostic miRNA with the reference amount. The detection of one or more such diagnostic miRNAs can be used to determine a likelihood of adverse prostate cancer pathology in a subject. The methods of the present disclosure also find use in facilitating treatment decisions for a subject.

The diagnostic miRNAs used in the methods of the present disclosure, as well as the methods of detection and analysis, are described in more detail below.

Diagnostic miRNAs for Detection

The methods of present disclosure involve detection of a diagnostic miRNA in a biological sample of a patient. Specifically, the present methods involve detection of mir-19a, mir-19b, mir-519c-5p, and/or mir-345.

In certain embodiments, the methods involve detection of one of mir-19a, mir-19b, and mir-519c-p. In other embodiments, the methods involve detection of mir-19a and mir-19b. In other embodiments, the methods involve detection of mir-19b and mir-519c-5p. In still other embodiments, the methods involve detection of mir-19a and mir-519c-5p. In certain embodiments, the methods involve detection of all three of mir-19a, mir-19b, and mir-519c-5p.

The methods can further involve detection of other biomarkers.

mir-19a

The diagnostic miRNA mir-19a, which may also be referred to as "hsa/mmu miR-19a" or "hsa-mir-19a," is a member of the mir-17-92 cluster (FIG. 3). Examples of the stem-loop sequence for hsa-mir-19a include those comprising a nucleic acid sequence of miRBase Accession No. MI0000073 and EntrezGene Gene ID 406979, and naturally occurring variants thereof. For example, the nucleic acid stem-loop sequence of MI0000073 is as follows:

(SEQ ID NO: 2839)
GCAGUCCUCUGUUAGUUUUGCAUAGUUGCACUACAAGAAGAAUGUAGUUG

UGCAAAUCUAUGCAAAACUGAUGGUGGCCUGC.

The stem-loop sequence may be processed to the mature sequence of mir-19a. Examples of the mature sequence include those comprising a nucleic acid sequence of miRBase Accession Nos. MIMAT0004490 and MIMAT0000073. For example, the nucleic acid sequence of MINIAT0004490 is as follows: AGUUUUGCAUAGUUG-CACUACA (SEQ ID NO:2840).

For example, the nucleic acid sequence of MIMAT0000073 is as follows:

UGUGCAAAUCUAUGCAAAACUGA.    (SEQ ID NO: 2841)

Figure 19A:
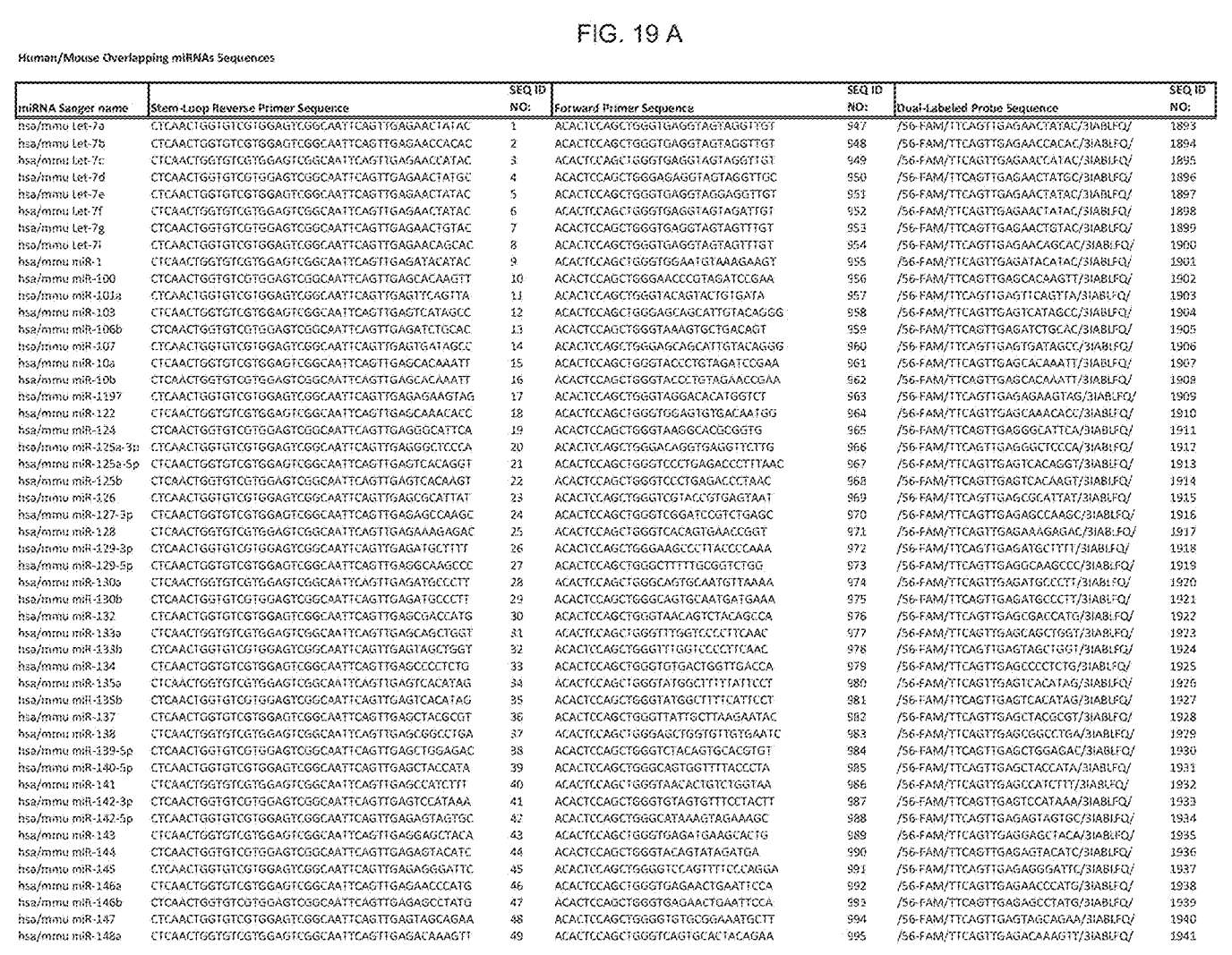
Figure 19A:
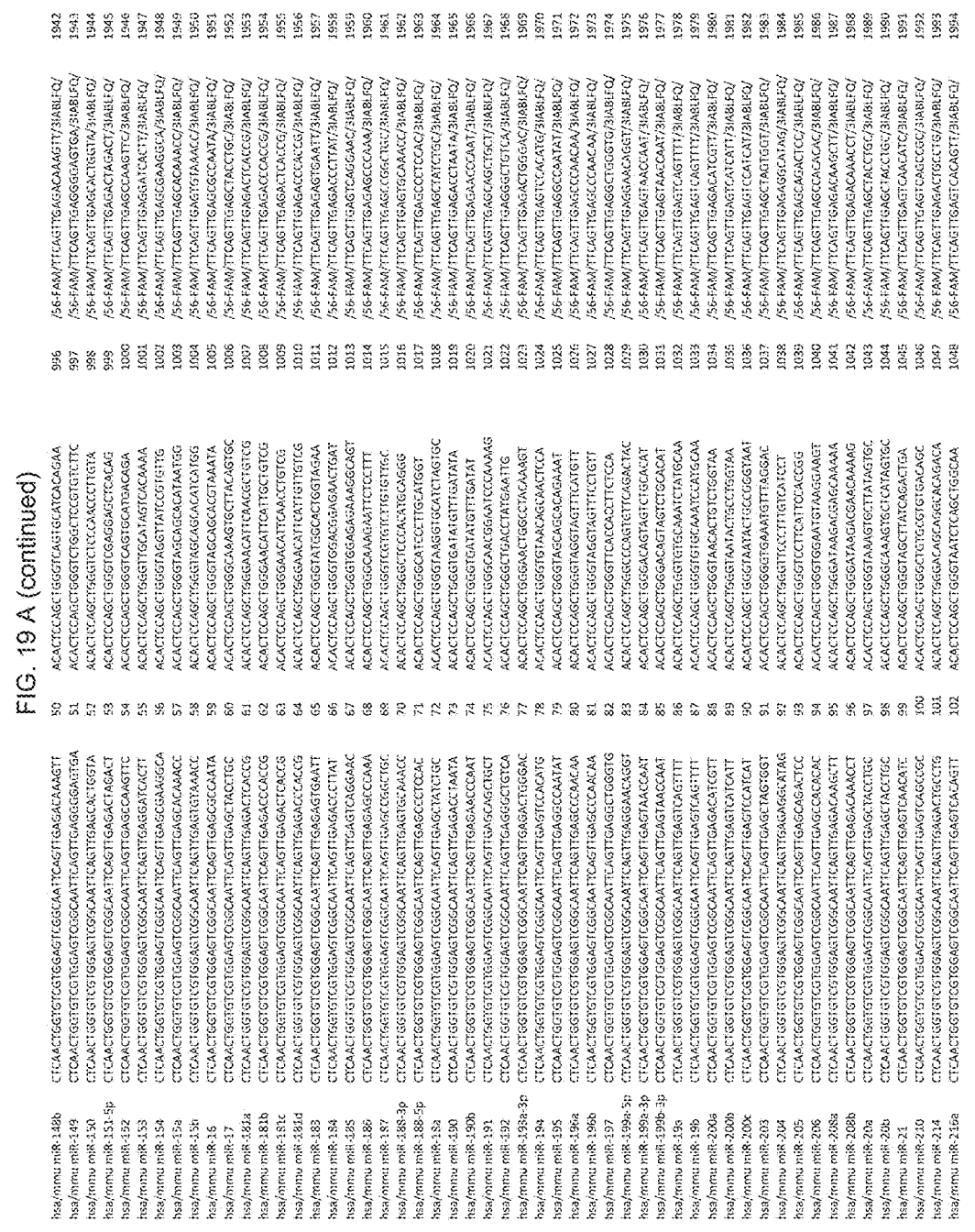
Figure 19A:
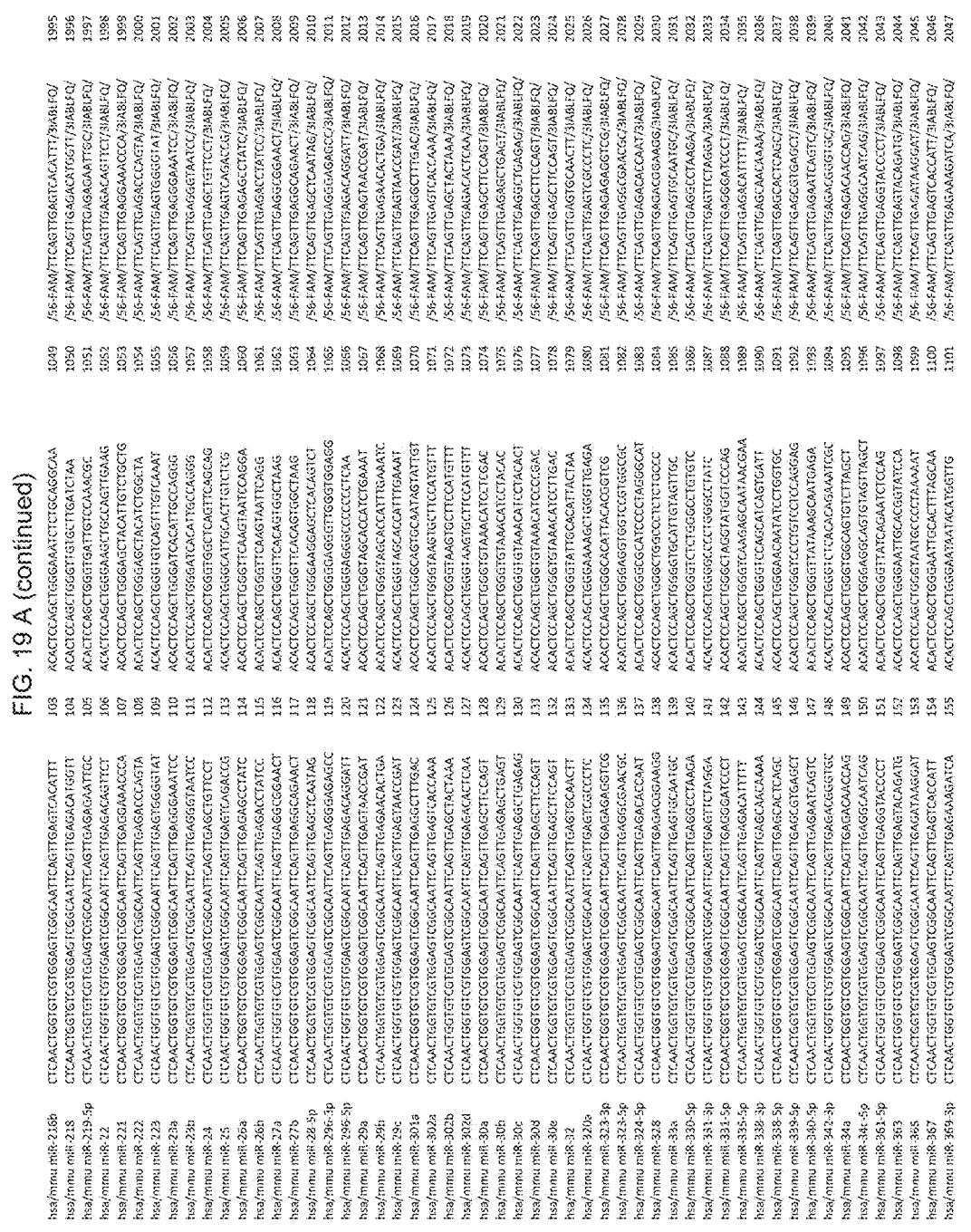
Figure 19:
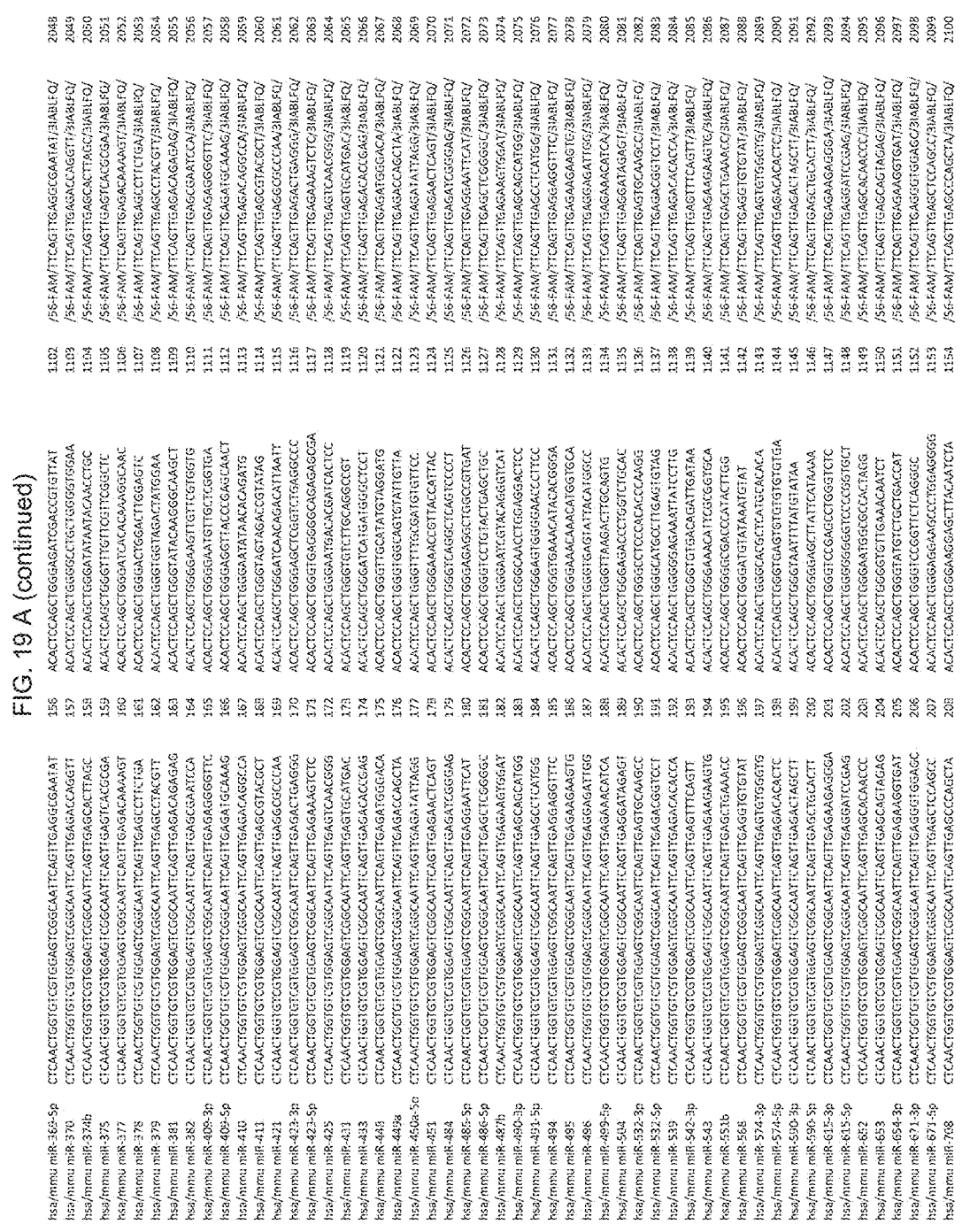
Figure 19B:
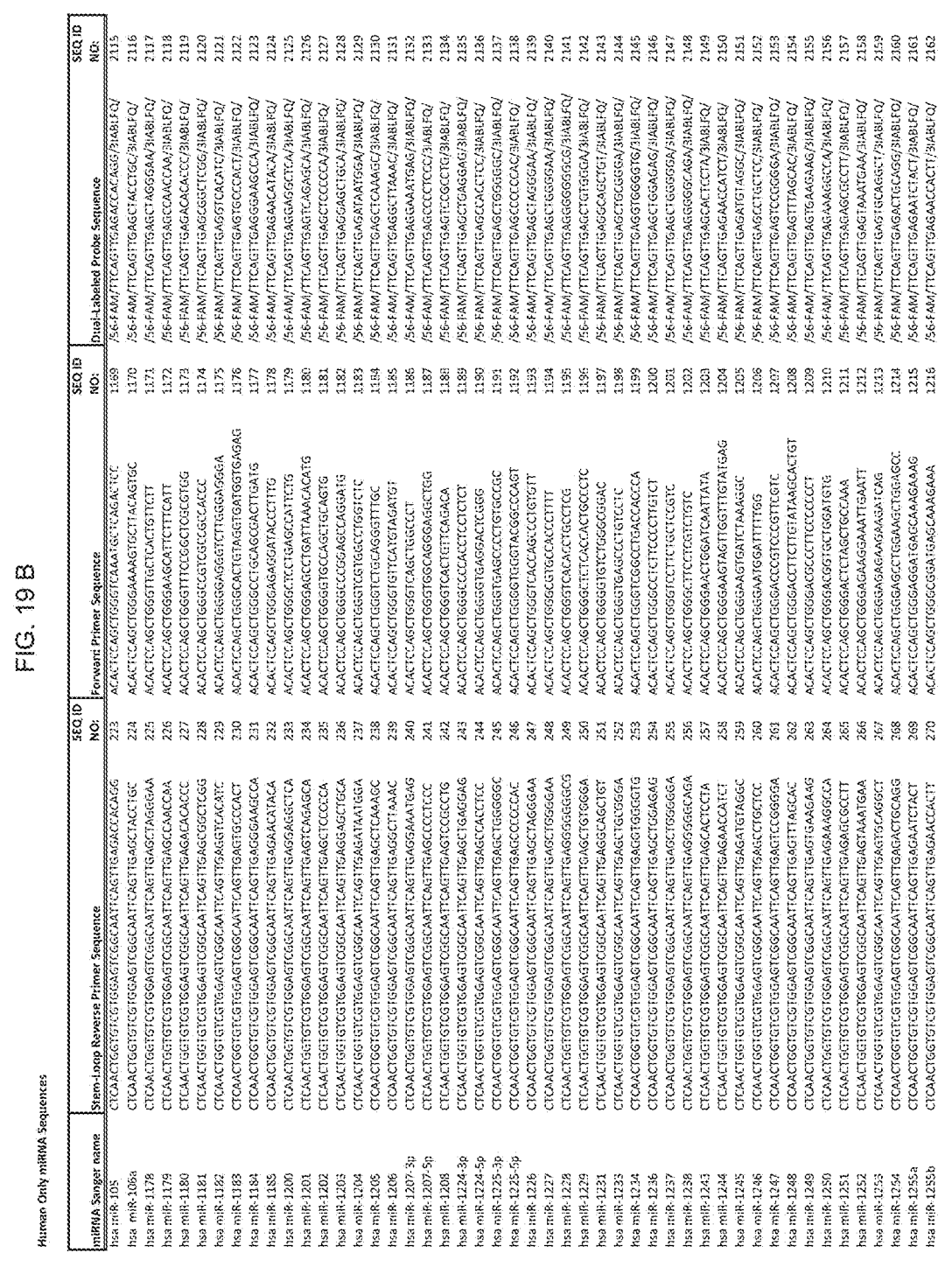
Figure 19:
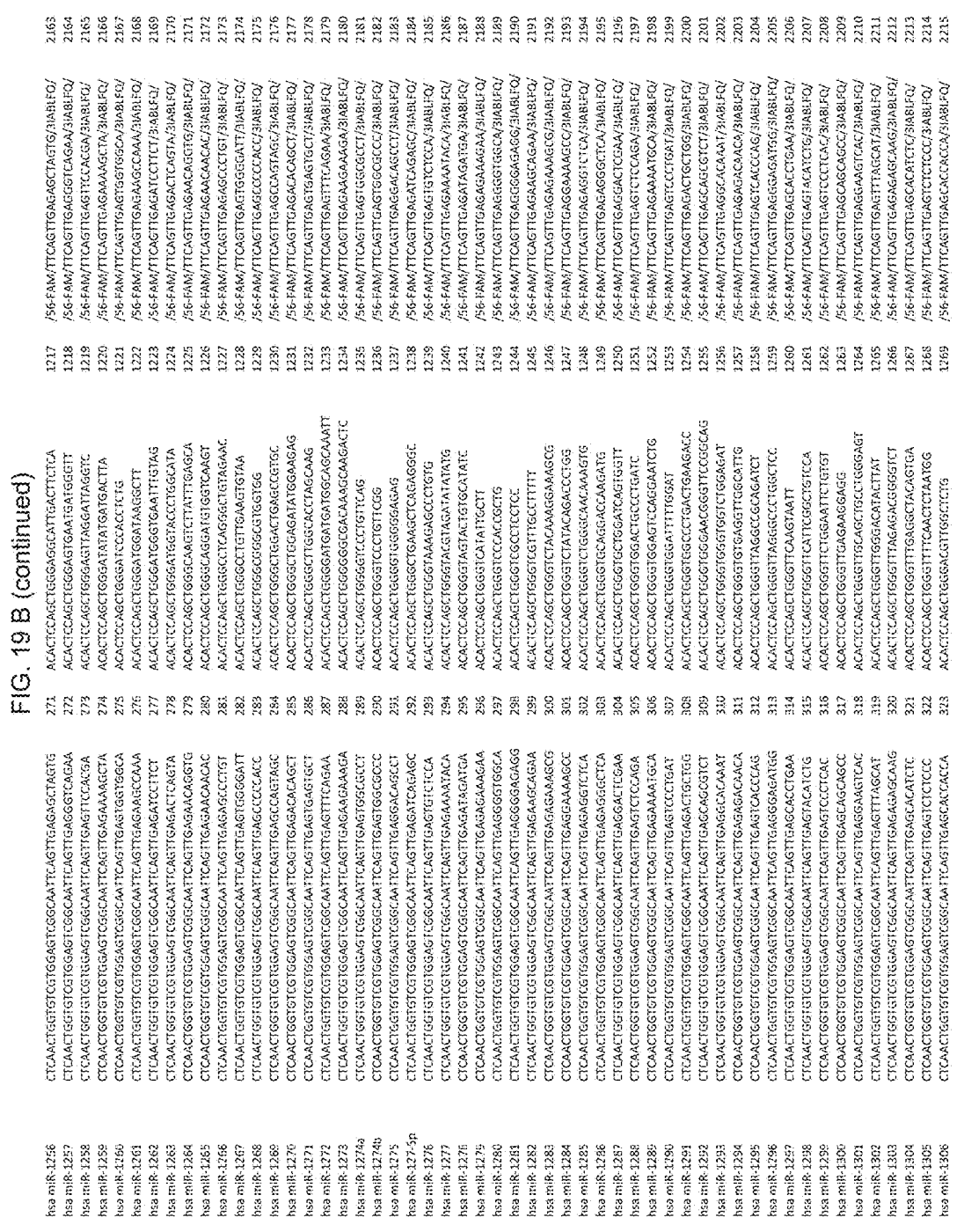
Figure 19:
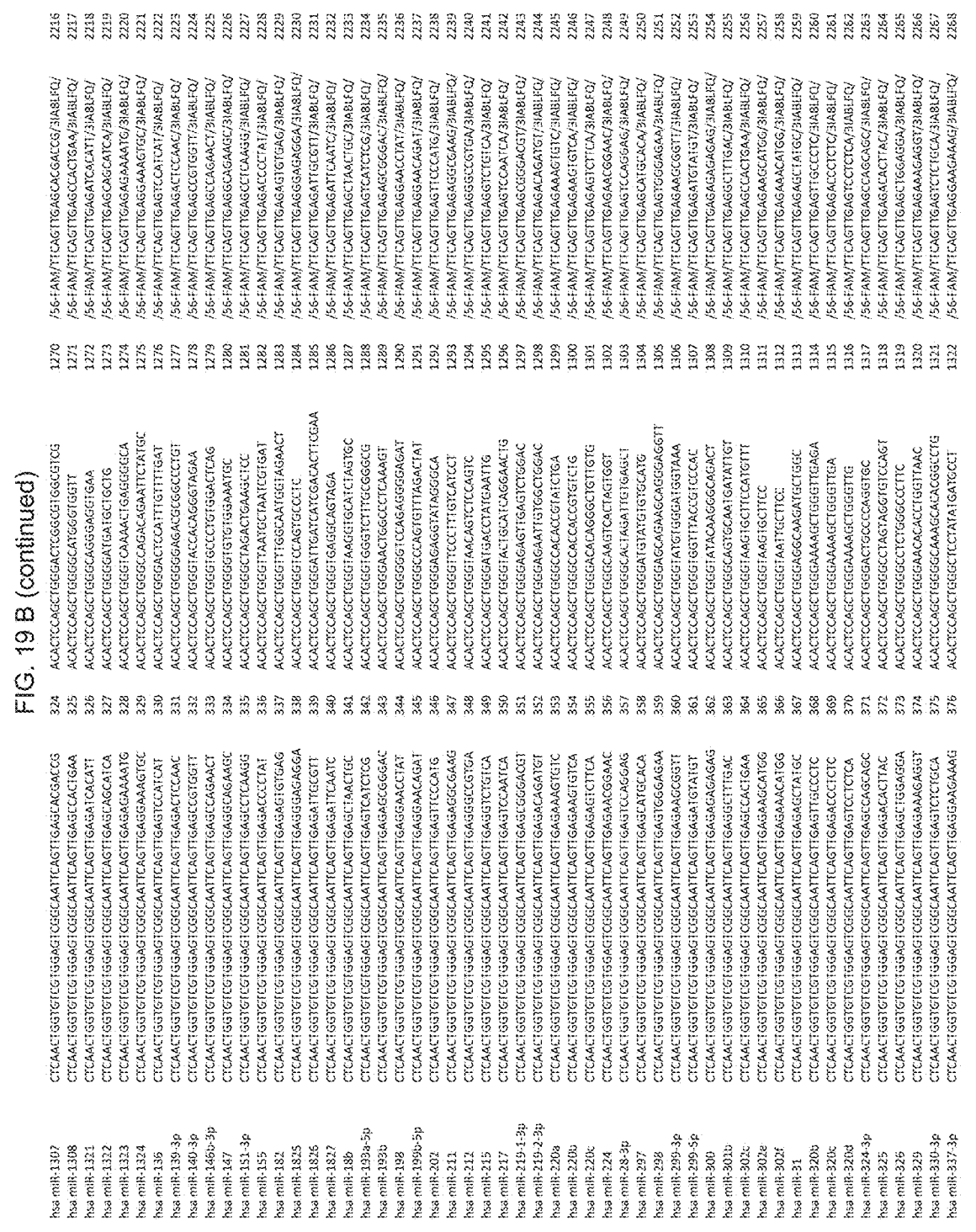
Figure 19:
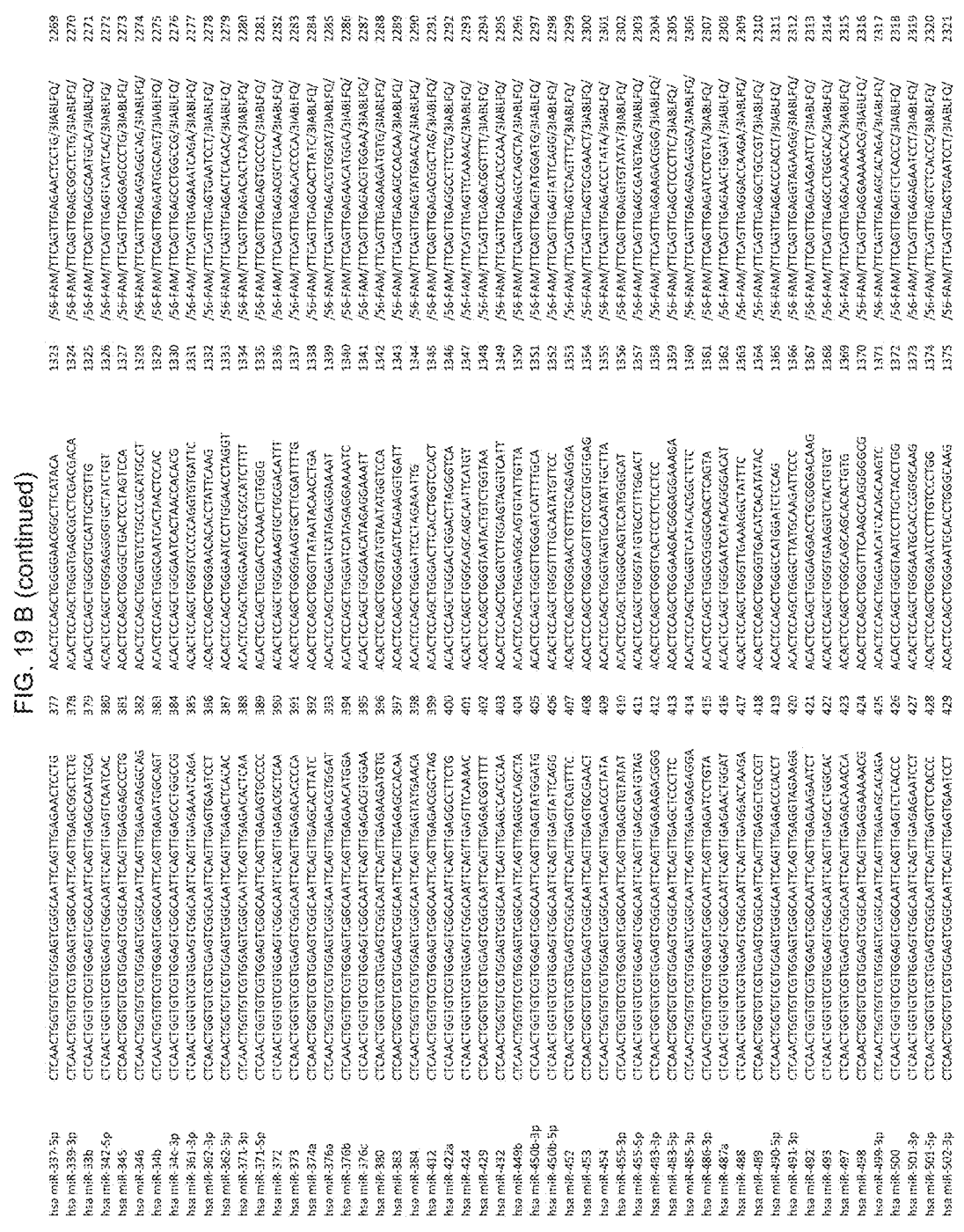
Figure 19:
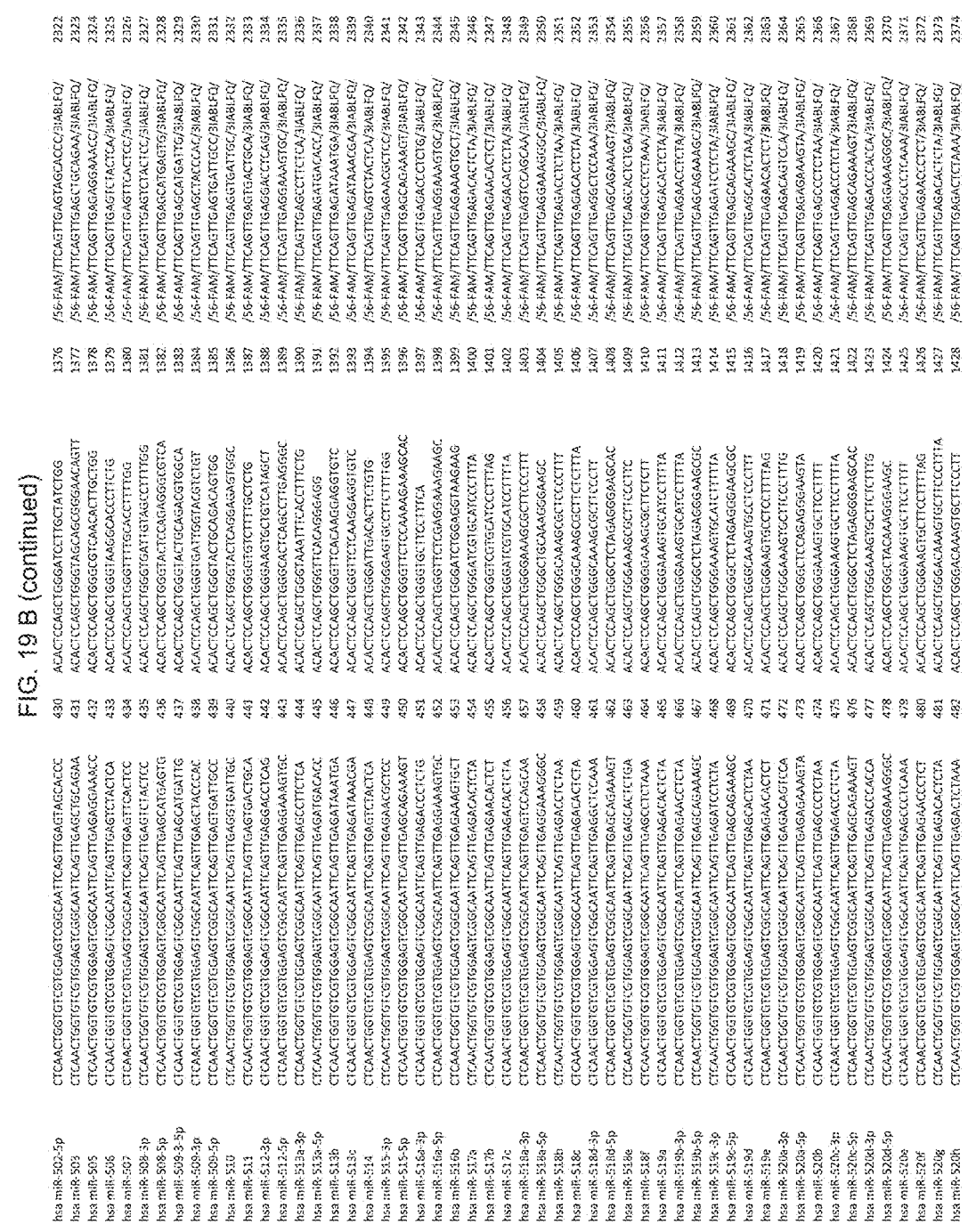
Figure 19:
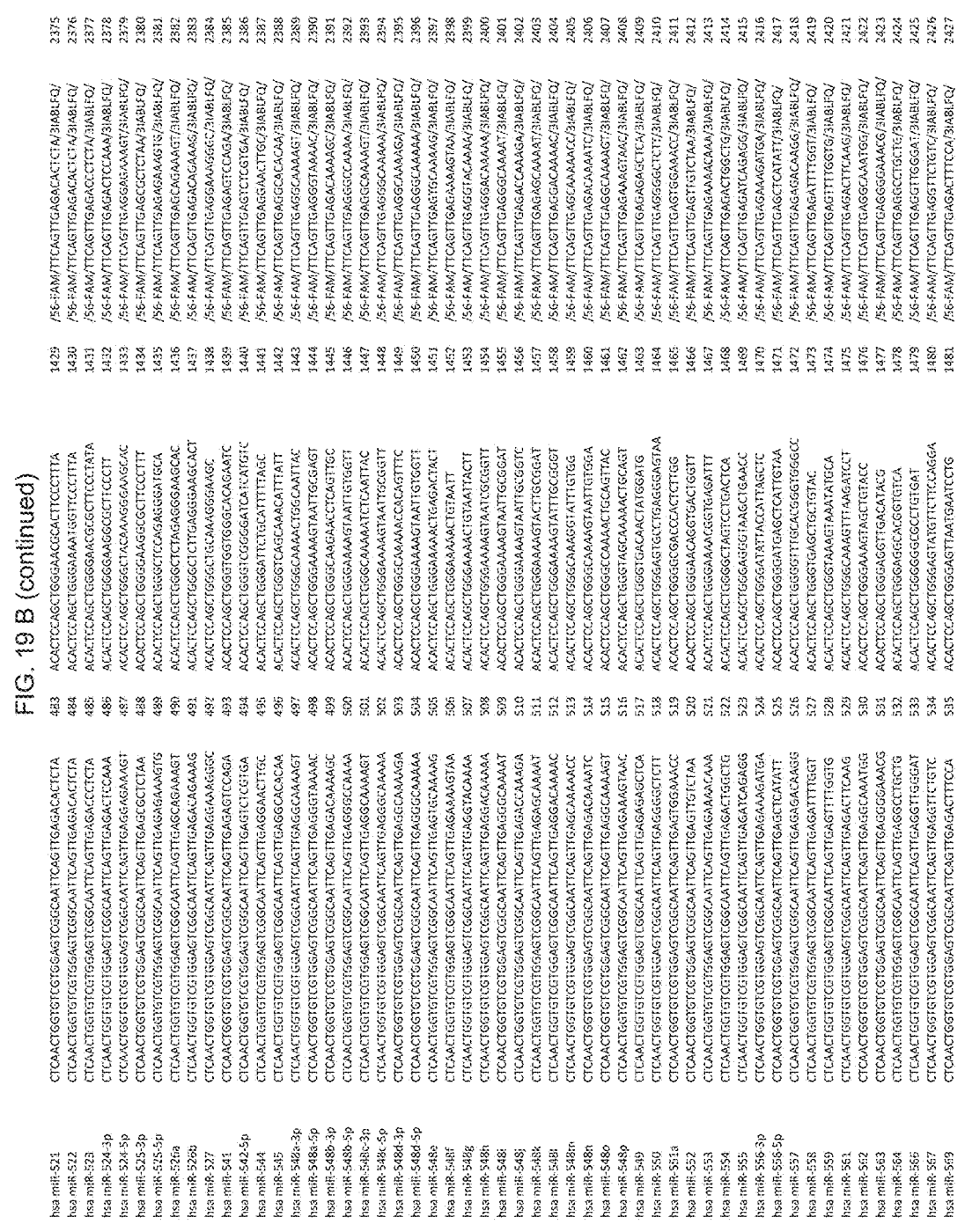
Figure 19:
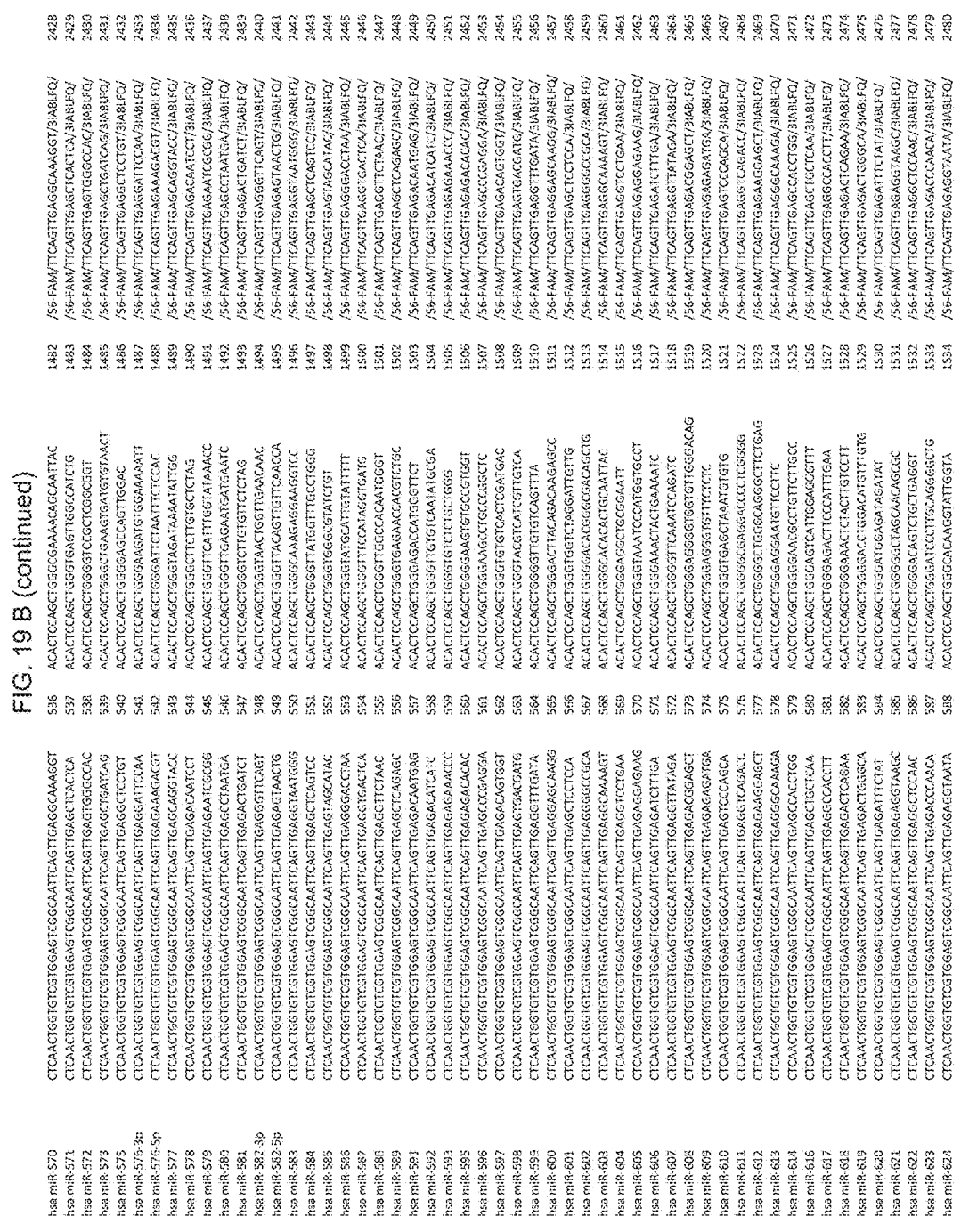
Figure 19:
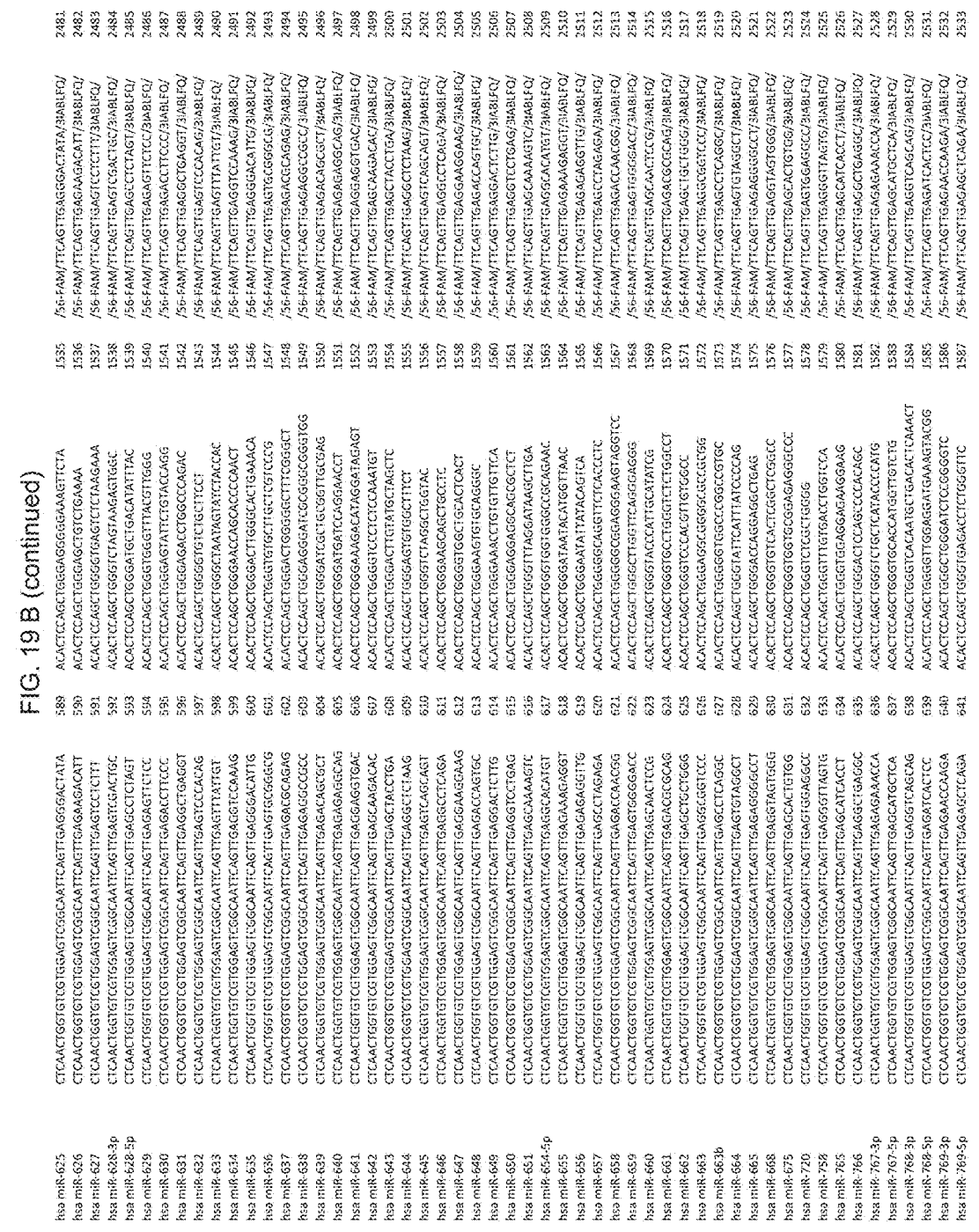
Figure 19C:
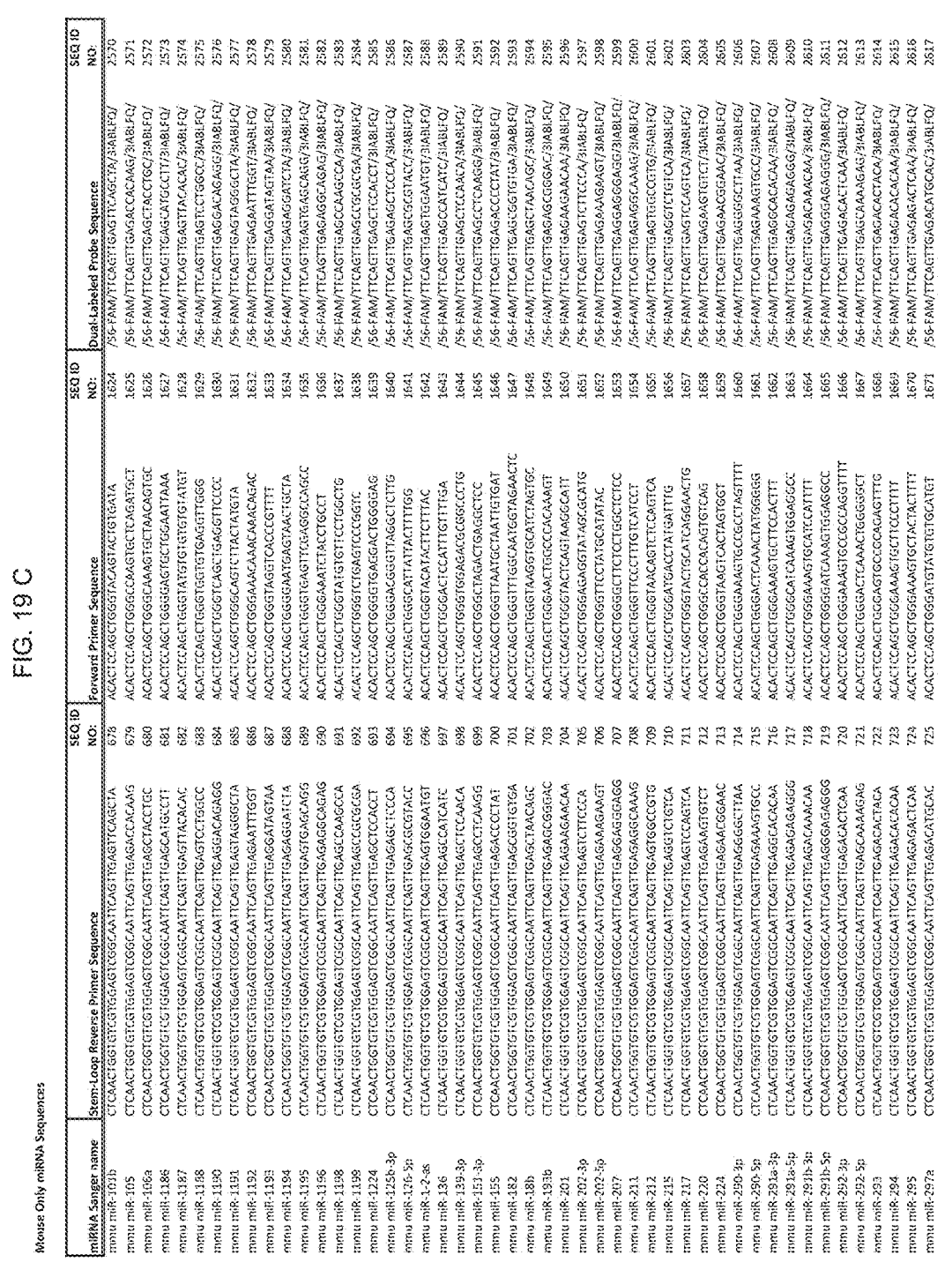
Figure 19:
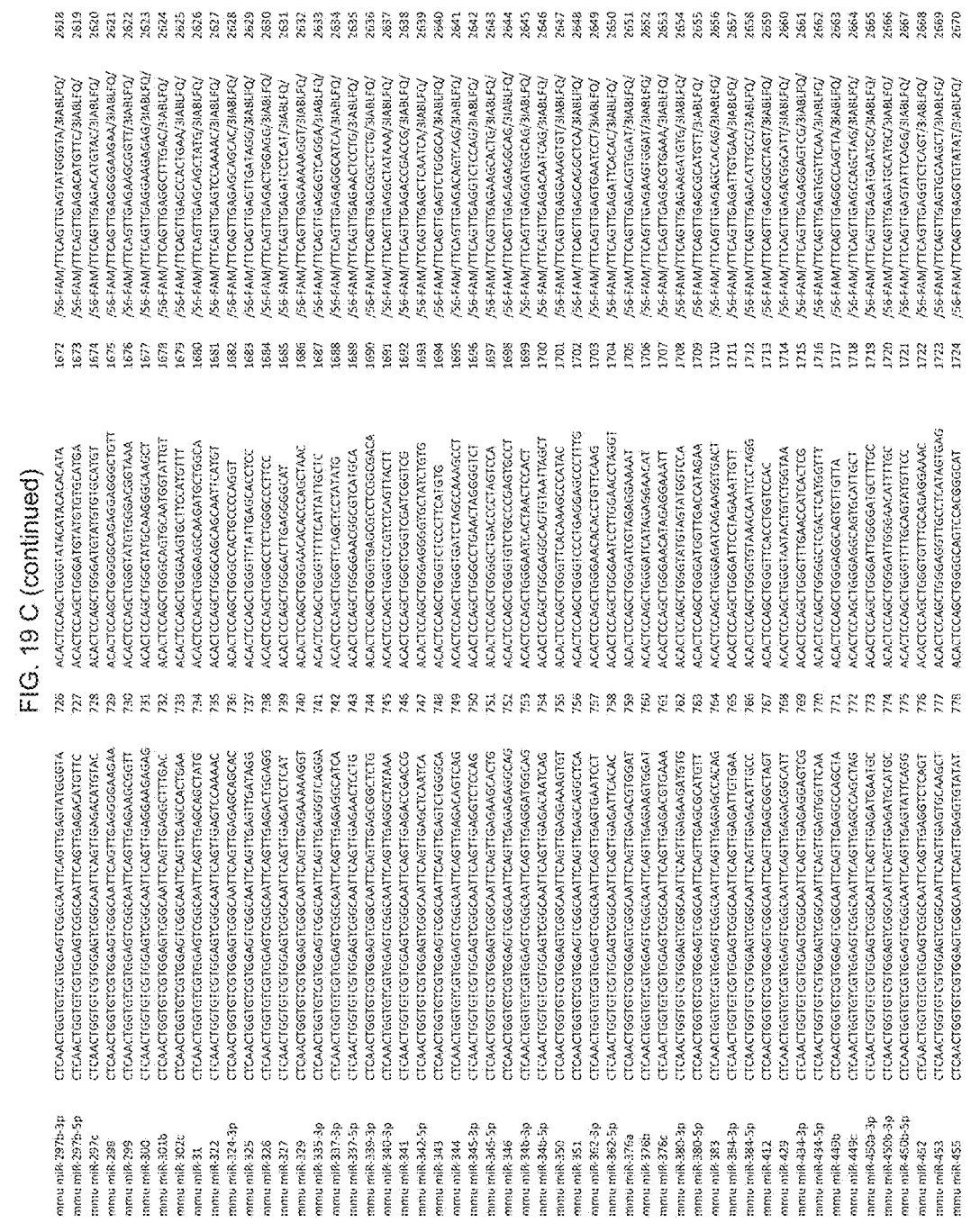
Figure 19C:
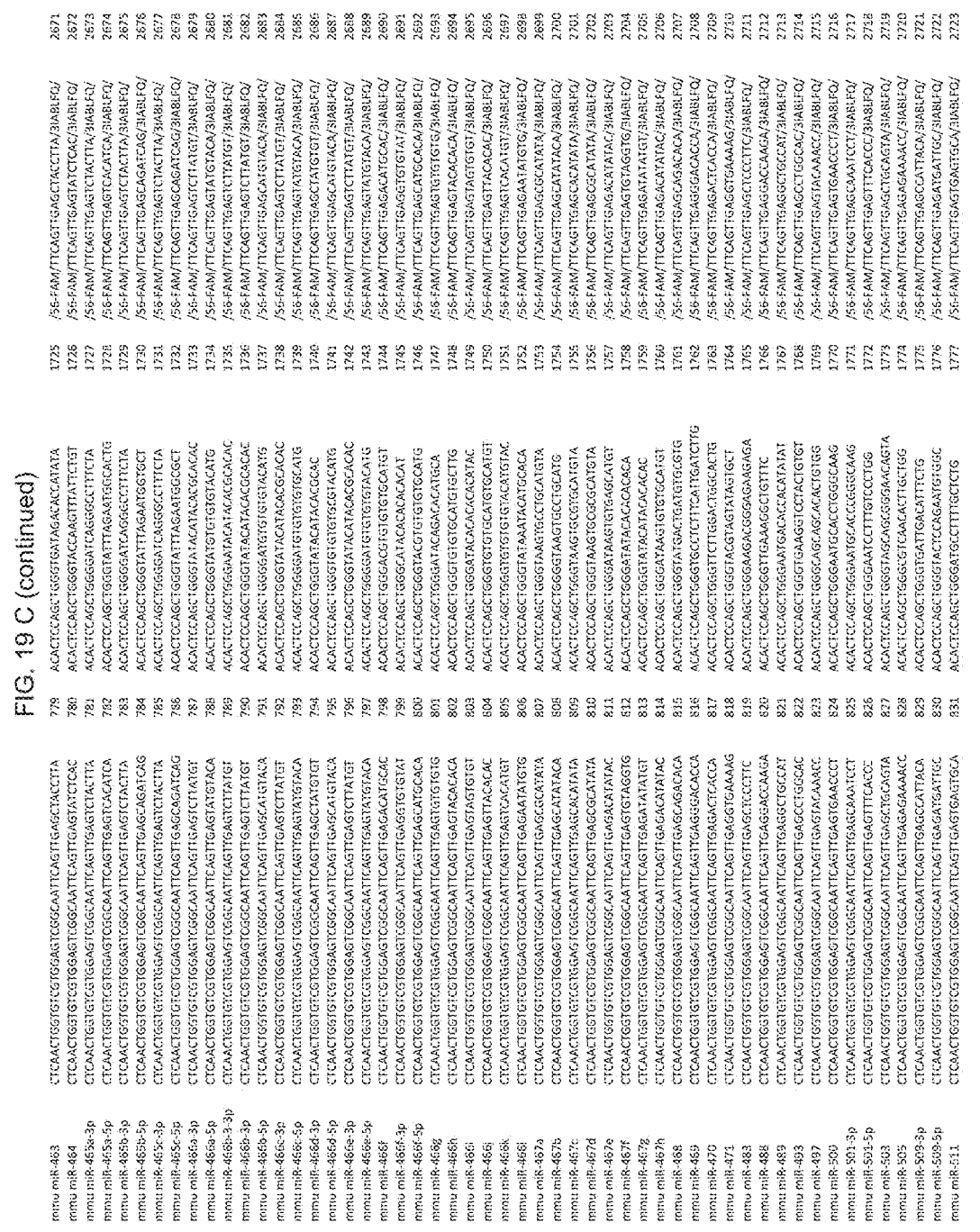
Figure 19:
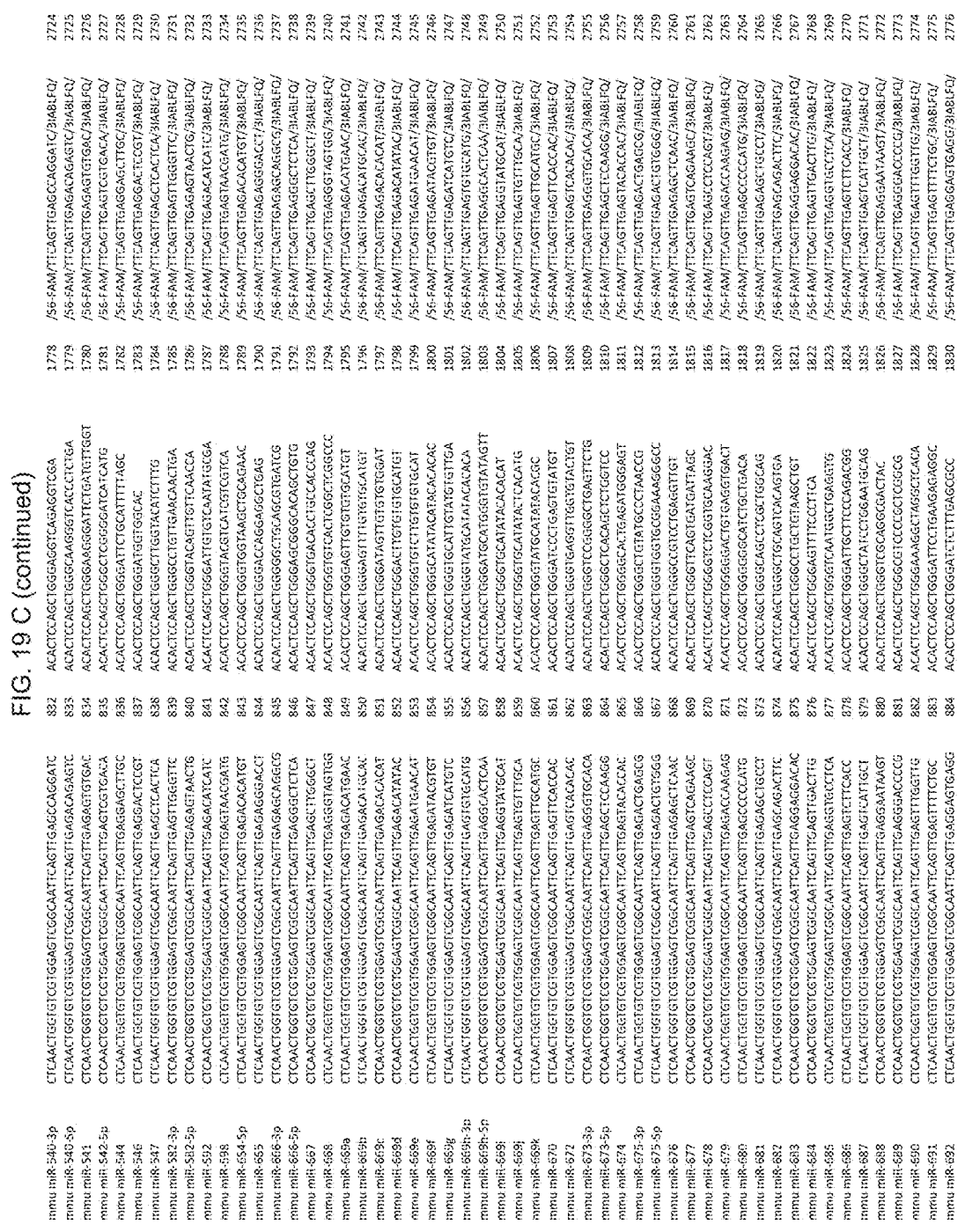
Figure 19:
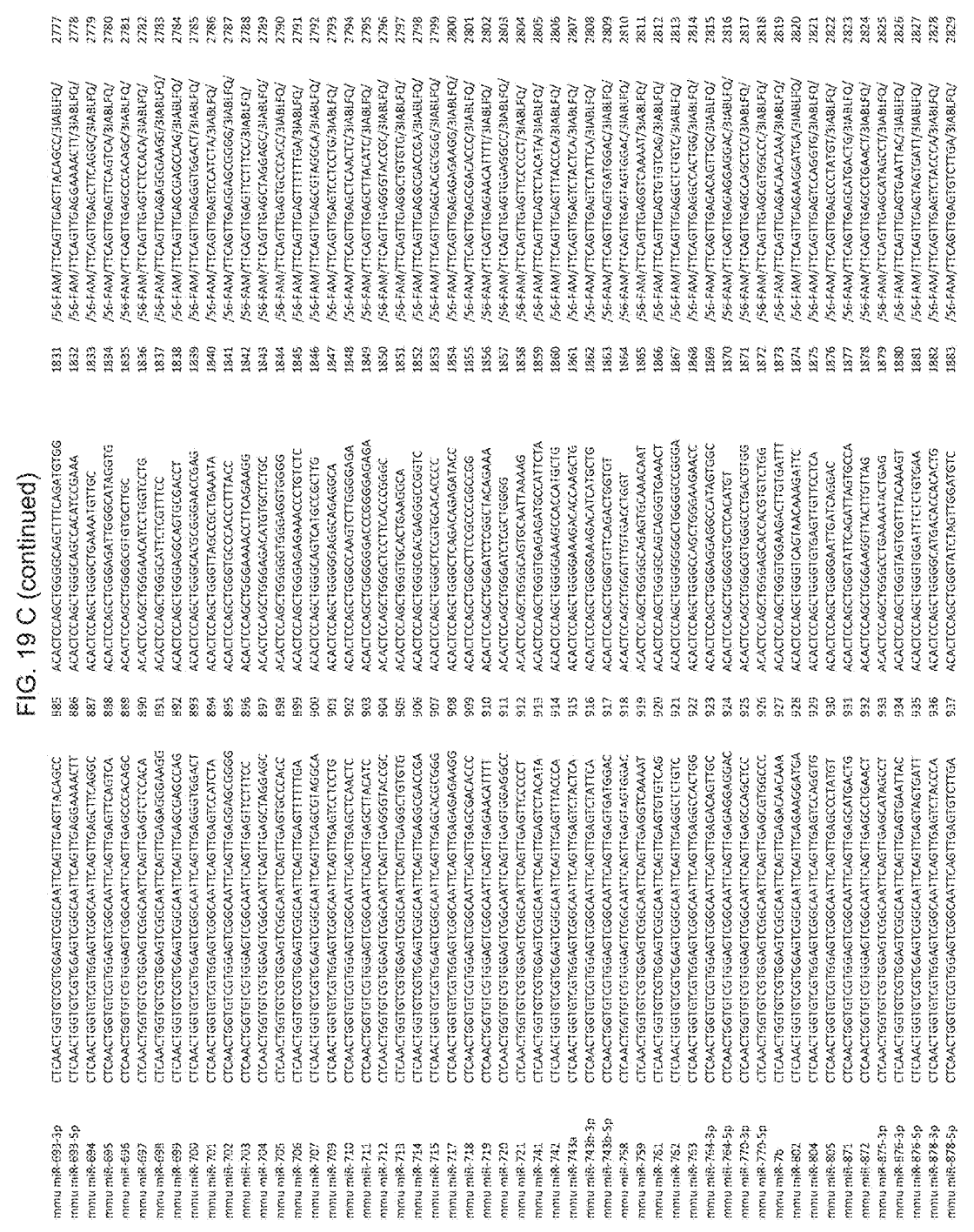

Detection of mir-19a encompasses detection of the mature miRNA, as well as detection of naturally occurring variants and fragments thereof found in a biological sample, and detection of a precursor molecule of the aforementioned miRNAs, such as the corresponding pri-miRNAs or pre-miRNAs. Detection of mir-19a can involve detection using one or more probes and/or primers, such as a probe or primer comprising SEQ ID NOs:86, 1032, or 1978 (FIG. 19).

mir-19b

The diagnostic miRNA mir-19b, which may also be referred to as "hsa/mmu miR-19b" or "hsa-mir-19b," is a member of the mir-17-92 cluster (FIG. 3). Examples of the stem-loop sequence for hsa-mir-19b include those comprising a nucleic acid sequence of miRBase Accession No. MI0000074 and EntrezGene Gene ID 406980, and naturally occurring variants thereof. For example, the nucleic acid stem-loop sequence of MI0000074 is as follows:

(SEQ ID NO: 2842)
CACUGUUCUAUGGUUAGUUUUGCAGGUUUGCAUCCAGCUGUGUGAUAUUC

UGCUGUGCAAAUCCAUGCAAAACUGACUGUGGUAGUG.

The stem-loop sequence may be processed to the mature sequence of mir-19b. Examples of the mature sequence include those comprising a nucleic acid sequence of miRBase Accession Nos. MIMAT0004491 and MIMAT0000074. For example, the nucleic acid sequence of MIMAT0004491 is as follows: AGUUUUGCAGGUUUG-CAUCCAGC (SEQ ID NO:2843).

For example, the nucleic acid sequence of MIMAT0000074 is as follows:

UGUGCAAAUCCAUGCAAAACUGA.    (SEQ ID NO: 2844)

Detection of mir-19b encompasses detection of the mature miRNA, as well as detection of naturally occurring variants and fragments thereof found in a biological sample, and detection of a precursor molecule of the aforementioned miRNAs, such as the corresponding pri-miRNAs or pre-miRNAs. Detection of mir-19b can involve detection using one or more probes and/or primers, such as a probe or primer comprising SEQ ID NOs:87, 1033, or 1979 (FIG. 19).

mir-519c-5p

The diagnostic miRNA mir-519c-5p, which may also be referred to as "hsa miR-519c-5p" or "hsa-mir-519c-5p," is a member of the mir-1283 cluster (FIG. 3). Examples of the stem-loop sequence for hsa-mir-519c-5p include those comprising a nucleic acid sequence of miRBase Accession No.

MI0003148 and EntrezGene Gene ID 574466, and naturally occurring variants thereof. For example, the nucleic acid stem-loop sequence of MI0003148 is as follows:

(SEQ ID NO: 2845)
UCUCAGCCUGUGACCCUCUAGAGGGAAGCGCUUUCUGUUGUCUGAAAGAA

AAGAAAGUGCAUCUUUUUAGAGGAUUACAGUUUGAGA.

The stem-loop sequence may be processed to the mature sequence of mir-519c-5p. Examples of the mature sequence include those comprising a nucleic acid sequence of miR-Base Accession No. MIMAT0002831. For example, the nucleic acid sequence of MIMAT0002831 is as follows: CUCUAGAGGGAAGCGCUUUCUG (SEQ ID NO:2846).

Detection of mir-519c-5p encompasses detection of the mature miRNA, as well as detection of naturally occurring variants and fragments thereof found in a biological sample, and detection of a precursor molecule of the aforementioned miRNAs, such as the corresponding pri-miRNAs or pre-miRNAs. Detection of mir-519c-5p can involve detection using one or more probes and/or primers, such as a probe or primer comprising SEQ ID NOs:469, 1415, or 2361 (FIG. 19).

mir-345

The diagnostic miRNA mir-345, which may also be referred to as "hsa-miR-345," is the predicted human homologue of a sequence cloned from rat neuronal tissue, later validated in human (FIG. 3). Examples of the stem-loop sequence for hsa-mir-345 include those comprising a nucleic acid sequence of miRBase Accession No. MI0000825 and EntrezGene Gene ID 442910, and naturally occurring variants thereof.

Reference miRNAs for Detection

In certain aspects, one or more reference miRNA(s) may be used to establish a reference amount against which an amount of a diagnostic miRNA may be compared.

Reference miRNAs may be detectable in a biological sample from a subject. Accordingly, specific reference miRNAs may vary depending on, e.g., the particular type of biological sample, the specific assay employed, purification and/or concentration steps, and other factors known to those of skill in the art.

Examples of reference miRNAs of interest include, but are not limited to, mir-17, mir-20a, mir-92a, mir-106a, mir-93, mir-25, let-7b, mir-24, mir-939, mir-1234, mir-522, mir-525-5p, mir-660, mir-941, mir-1274a, mir-1274b, mir-302f, mir-34c-3p, mir-663, mir-197, mir-223, mir-297, mir-346, mir-484, mir-486, mir-584, mir-638, mir-629, mir-720, mir-942, mir-1208, and mir-1243. The sequences of the mature miRNA forms of the foregoing reference miRNAs and their corresponding stem-loop sequences may be found, e.g., in the miRBase sequence database. The miRBase sequence database is described in Kozomara A, Griffiths-Jones S. (2011) *NAR* 39 (Database Issue):D152-D157; the disclosure of which is incorporated herein by reference.

In certain aspects, a plurality of reference miRNAs may be detected from a biological sample, such as 2 or more, including 10 or more, e.g., about 2 to 10, about 10 to 20, about 20 to 30, about 30 to 40, about 40 to 50, or about 50 to 100.

Detection of reference miRNAs encompasses detection of the mature miRNA, as well as detection of naturally occurring variants and fragments thereof found in a biological sample, and detection of a precursor molecule of the aforementioned miRNAs, such as the corresponding pri-miRNAs or pre-miRNAs. Detection of reference miRNAs can involve detection using one or more probes and/or primers, such as a probe or primer comprising: mir-17 (SEQ ID NOs: 60, 1006, or 1952), mir-20a (SEQ ID NOs: 97, 1043, or 1989), mir-92a (SEQ ID NOs: 664, 1610, 2556, 946, 1892, or 2838), mir-106a (SEQ ID NOs: 224, 1170, 2116, 680, 1626, or 2572), mir-93 (SEQ ID NOs: 218, 1164, or 2110), mir-25 (SEQ ID NOs: 113, 1059, or 2005), let-7b (SEQ ID NOs: 2, 948, or 1894), mir-24 (SEQ ID NOs: 112, 1058, or 2004), mir-939 (SEQ ID NOs: 671, 1617, or 2563), mir-1234 (SEQ ID NOs: 253, 1199, or 2145), mir-522 (SEQ ID NOs: 484, 1430, or 2376), mir-525-5p (SEQ ID NOs: 489, 1435, or 2381), mir-660 (SEQ ID NOs: 623, 1569, or 2515), mir-941 (SEQ ID NOs: 673, 1619, or 2565), mir-1274a (SEQ ID NOs: 289, 1235, or 2181), mir-1274b (SEQ ID NOs: 290, 1236, or 2182), mir-302f (SEQ ID NOs: 366, 1312, or 2258), mir-34c-3p (SEQ ID NOs: 384, 1330, or 2276), mir-663 (SEQ ID NOs: 626, 1572, or 2518), mir-197 (SEQ ID NOs: 82, 1028, or 1974), mir-223 (SEQ ID NOs: 109, 1055, or 2001), mir-297 (SEQ ID NOs: 358, 1304, or 2250), mir-346 (SEQ ID NOs: 382, 1328, 2274, 752, 1698, or 2644), mir-484 (SEQ ID NOs: 179, 1125, or 2071), mir-584 (SEQ ID NOs: 551, 1497, or 2443), mir-638 (SEQ ID NOs: 603, 1549, or 2495), mir-629 (SEQ ID NOs: 594, 1540, or 2486), mir-720 (SEQ ID NOs: 632, 1578, 2524, 911, 1857, or 2803), mir-942 (SEQ ID NOs: 674, 1620, or 2566), mir-1208 (SEQ ID NOs: 242, 1188, or 2134), and mir-1243 (SEQ ID NOs: 257, 1203, or 2149) (FIG. 19).

Subjects

The methods of the present disclosure can be used to determine a likelihood of adverse prostate cancer pathology in a male subject. The subject can be any subject having, suspected of having, or at risk of, prostate cancer, and includes subjects having, suspected of having, or at risk of having any proliferative lesion or abnormality of the prostate. Subjects include patients undergoing therapy, e.g., undergoing therapy to treat suspected or diagnosed prostate cancer or undergoing therapy which places the subject at risk of developing prostate cancer.

Subjects to be tested using a method of the present disclosure include individuals who present with or have presented with one or more symptoms of prostate cancer. Examples of such symptoms include any symptoms indicative of prostate cancer such as trouble urinating, decreased force in the stream of urine, blood in the urine, blood in the semen, swelling in the legs, discomfort in the pelvic area, bone pain, and/or any abnormal levels of PSA.

Subjects at risk prostate cancer include aged subjects (e.g., 50 or older, or 65 or older), subjects of particular races (e.g., black), and subjects with a family history of cancer, including prostate cancer.

Biological Samples

Suitable biological samples useful in the methods of the present disclosure include biological fluids (e.g., a blood sample, e.g., whole blood, blood fraction (e.g., serum, plasma)), and other liquid samples of biological origin, as well as solid tissue samples such as a liver biopsy specimen. Where the biological sample is a blood sample, the blood sample can be obtained from fresh blood or stored blood (e.g. in a blood bank). The biological sample can be a blood sample expressly obtained for an assay of the present disclosure or a blood sample obtained for another purpose which can be subsampled for an assay of the present disclosure.

Samples can be manipulated after procurement, such as by treatment with reagents, solubilization, and/or enrichment for certain components for an analyte(s) to be assayed. Samples can be pretreated as necessary by dilution in an appropriate buffer solution, concentrated if desired, or fractionated by any number of methods including but not limited to ultracentrifugation, fractionation by fast performance liquid chromatography (FPLC), or precipitation. For example, in certain aspects the sample is subfractionated into, e.g., vesicular and non-vesicular components (e.g. naked ribonucleoproteins) before subsequent analysis. Suitable means of sub-fractioning a sample are known in the art and described in, e.g., Duttagupta R, et al. (2011) *PLoS ONE* 6(6): e20769; the disclosure of which is incorporated herein by reference. Any of a number of standard aqueous buffer solutions, employing one of a variety of buffers, such as phosphate, Tris, or the like, at physiological pH can be used. In general, after isolation, samples (such as blood samples) are stored at −80° C. until assaying.

Assay Formats and Detection Methods

Biomarkers for analysis in connection with the methods of the present disclosure (e.g., mir-19a, mir-19b, and/or mir-519c-5p) can be detected using a variety of methods, with methods suitable for quantitative and semi-quantitative assays being of particular interest. Examples of detection methods include, but are not limited to, various assays involving reverse transcription of RNA and nucleic acid amplification (e.g., PCR, quantitative real time PCR, nucleic acid microarrays, sequencing, bead arrays, and the like).

For example, isolated miRNA from a biological sample can be used in hybridization or amplification assays that include, but are not limited to, Southern or Northern analyses, polymerase chain reaction (PCR) analyses and probe arrays. One method for the detection of miRNA levels involves contacting the isolated miRNA with a nucleic acid molecule (probe) that can hybridize to biomarker-encoding nucleic acid. The nucleic acid probe can be for example, a full-length cDNA, or a portion thereof, such as an oligonucleotide of at least 7, 15, 30, 50, 100, 250 or 500 nucleotides in length and sufficient to specifically hybridize under stringent conditions to biomarker-encoding nucleic acid. Examples of suitable probes include, but are not limited to, probes listed in FIG. 19 (e.g., SEQ ID NOs: 1-2838).

In one embodiment, the miRNA from a biological sample is immobilized on a solid surface and contacted with a probe. In an alternative embodiment, the probe(s) are immobilized on a solid surface and the miRNA isolated from the biological sample is contacted with the probe(s), e.g., as in an array format.

Methods of detecting levels of biomarker expression in a sample can involve any suitable method of nucleic acid amplification, e.g., by RT-PCR, ligase chain reaction, or any other nucleic acid amplification method, followed by the detection of the amplified molecules using techniques well known to those of skill in the art. In one example, biomarker expression is assessed by quantitative fluorogenic RT-PCR (e.g., such as using TaqMan™, SYBR Green, and the like). Such methods typically utilize pairs of oligonucleotide primers that are specific for a biomarker-encoding nucleic acid. Methods for designing oligonucleotide primers specific for a known sequence are well known in the art.

In certain embodiments, the method employs a detection approach that involves multiplex qRT-PCR, such as the microfluidic-based multiplex qRT-PCR method as described in Moltzahn, et al. (2010) *Cancer Res* 71:550-560; the disclosure of which is incorporated herein by reference. Detection methods of interest further include, but are not limited to, those described in Mitchell P S, et al. (2008) *PNAS* 105(30):10.513-10518 and U.S. Patent Publication Nos. 2011/0275534 and 2012/0264638 the disclosures of which are incorporated herein by reference.

Determination of a Likelihood of Adverse Prostate Cancer Pathology

The methods of the present disclosure include methods for determining a likelihood of adverse prostate cancer pathology in a subject. Such methods generally involve determining an amount of at least one diagnostic miRNA using an assay or detection method as described herein). The amount of the diagnostic miRNA(s) may be compared with a reference amount, and the results of the comparison may be used to indicate the likelihood of adverse prostate cancer pathology in the subject.

In certain aspects, a reference amount is calculated using the level of one or more miRNA(s). In certain aspects, a reference amount is instead, or also, calculated using one or more biomolecule(s) that are not miRNA(s), such as polypeptides (e.g., peptides, proteins, etc.), and/or nucleic acids (e.g., DNA, long non-coding RNA molecules, small RNA(s), spiked-in RNAs, etc.).

In certain aspects, the reference amount may be a control amount of the diagnostic miRNA, such as the amount of the diagnostic miRNA in a healthy individual or a population of healthy individuals. The reference amount may, in some aspects, be the amount of the diagnostic miRNA from a different individual or group of individuals, such as a control population that does not have adverse prostate cancer pathology, e.g., a control population as described in Examples.

In some embodiments, the reference amount is an amount of the diagnostic miRNA from the same subject, measured at a prior time point. For instance, the prior time point may be a time point that is prior to the subject exhibiting clinical presentations of prostate cancer and/or at an earlier stage of the disease.

Embodiments further include calculating the reference amount from the amounts of a plurality of reference miRNAs. For example, the reference amount may be calculated from cycle threshold (Ct) values of a plurality of reference miRNAs from the biological sample, such as by computing a normalized Ct value, such as by computing a mean, and/or median Ct value from the plurality. Any convenient means of normalizing, e.g., a Ct value may be employed in calculating the reference amount. In certain aspects, a comparison may include the use of a model, such as a logistic regression model, classification tree model, random forest classification model, and the like.

Embodiments further include calculating the reference amount using spike-in small RNAs. The use of such spike-in small RNAs are described in, e.g., Cronin M, et al. (2004) *Clin. Chem* 50(8):1464-1471 and M N McCall and R A Irizarry (2008) *Nucleic Acids Res.* 36(17): e108; the disclosures of which are incorporated by reference.

In some embodiments, a reference amount is determined using one or more of the method(s) described in Peltier H J and Latham G J (2008) *RNA* 4(5):844-852; Timoneda O, et al. (2012) *PLoS One* 7(9):e44413; Meyer S U, et al. (2012) *PLoS One* 7(6):e38946; Wylie D, et al. (2011) *BMC Res Notes* 4:555; Kirschner M B, et al. (2011) *PLoS One* 6(9):e24145; Roa W, et al. (2010) *Clin Invest Med* 33(2): E124; Schaefer A, et al. (2010) *Exp. Mol. Med.* 42(11):749-58; Galiveti C R, et al. (2010) *RNA* 16(2):450-461; Bissels U, et al. (2009) *RNA* 15(12):2375-2384; Mestdagh P, et al. (2009) *Genome Biol.* 10(6):R64; and/or variant(s) or comparable method(s) to the method(s) of any of the foregoing, the disclosures of which are incorporated herein by reference.

In addition to the amount of one or more diagnostic miRNA(s), methods of the present disclosure may involve the use of one or more additional risk factors to determine a likelihood of adverse prostate cancer pathology. Such additional risk factors include factors that may be ascertained without a biopsy of the subject (e.g., a biopsy of the subject's prostate). Such risk factors include, but are not limited to, the subject's age, race, PSA level, clinical stage, and the like. Accordingly, in such embodiments the subject methods may be performed on a subject without requiring a biopsy of the subject.

Additional risk factors of interest further include risk factors that require a biopsy. Such risk factors include, but are not limited to, the subject's primary biopsy Gleason score, secondary biopsy Gleason score, Gleason score sum, percentage cancer in biopsy cores, and the like.

The amounts of diagnostic miRNA(s) and/or one or more additional risk factors may be combined to provide an assessment of the likelihood of adverse prostate cancer pathology in a subject. For example, the diagnostic miRNA(s) can be combined with one or more risk factors as described above in an algorithm, which facilitates an assessment of the likelihood of adverse prostate cancer pathology in a subject.

For example, the likelihood of adverse prostate cancer pathology can be based on an algorithm generally described as follows:

$$\text{Score} = (+1 \text{ if } mir\text{-}19a > X_{mir\text{-}19a} \text{ or } mir\text{-}19b > X_{mir\text{-}19b}) + \quad \text{(Algorithm I)}$$
$$(+1 \text{ if } mir\text{-}519c\text{-}5p < X_{mir\text{-}519c\text{-}5p}) +$$
$$(+1 \text{ if } mir\text{-}345 < X_{mir\text{-}345})$$

where
$X_{mir\text{-}19a}$ is a reference amount for mir-19a.
$X_{mir\text{-}19b}$ is a reference amount for mir-19b,
$X_{mir\text{-}519\text{-}5p}$ is a reference amount for mir-519c-5p, and
$X_{mir\text{-}345}$ is a reference amount for mir-345.

In certain embodiments, $X_{mir\text{-}19a} = X_{mir\text{-}19b} = X_{mir\text{-}519c\text{-}5p} = X_{mir\text{-}345}$. For example, in embodiments where a reference amount is calculated from the amounts of a plurality of reference miRNAs, $X_{mir\text{-}19a}$, $X_{mir\text{-}19b}$, $X_{mir\text{-}519c\text{-}5p}$, and $X_{mir345}$ may be equivalent. In Algorithm I and the algorithms presented below, the higher the Score, the greater the likelihood of adverse prostate cancer pathology in the subject.

In certain aspects, the likelihood of adverse prostate cancer pathology is based on an algorithm that may be generally described as follows:

Score=(Algorithm I)+(1 if subject's age≥50)    (Algorithm II)

In certain aspects, the likelihood of adverse prostate cancer pathology is based on an algorithm that may be generally described as follows:

Score=(Algorithm I or II)+(1 if subject's clinical stage is T3a)    (Algorithm III)

In certain aspects, the likelihood is based on an algorithm that may be generally described as follows:

Score=(Algorithm I, II, or III)+(1 if subject's PSA level is between 6.1 and 10.0)+(2 if subject's PSA level is between 10.1 and 20.0)+(3 if subject's PSA level is between 20.1 and 30.0)+(4 if subject's PSA level is 30.1 or higher)    (Algorithm IV)

In certain aspects, the detection of one or more diagnostic miRNA may be incorporated into an existing prostate cancer prediction algorithm, such as the CAPRA score described in Cooperberg, et al. (2005) *J. Urol.* 173(6):1938-1942; the disclosure of which is incorporated herein by reference. For example, FIG. 8, Panel B shows modified CAPRA scores produced by adding one point to the score for each positive diagnostic miRNA (considering only mir-19a, mir-19b, and mir-519c-5p), where positivity is detection of a value exceeding the median detectable value. The resulting score (miRNA+CAPRA) displayed a significant increasing linear trend (p<0.001) in outcome risk, with 100% of the 12 individuals scored at the highest level (5) classified as cases. The detection of one or more diagnostic miRNA may be incorporated into other existing predictive tools, including nomograms, multivariable models, and the like. Predictive tools of interest include, but are not limited to, those described in Shariat S F, et al. (2008) *Curr. Opin. Urol.* 18(3):279-296 and Shariat S F, et al. (2008) *Cancer.* 113 (10:3075-3099; the disclosures of which are incorporated herein by reference.

In certain aspects, combination of the detection of one or more diagnostic miRNA (e.g., mir-19a, mir-19b, mir-519c-5p, mir-345, or any combination thereof) with an existing tool may use a statistical and/or learning machine algorithm(s) to find an optimal combination of the one or more diagnostic miRNA(s) with the other factor(s) considered by the prediction tool. A variety of statistical or machine learning algorithms are known in the art and may facilitate such a combination, such as genetic algorithms, support vector machines, neural networks, hidden Markov models, Bayesian networks, and the like.

Reports

The methods of the present disclosure can include generating a report indicating the results of the method and providing guidance as to how the results might be applied to the care of the subject. A "report," as described herein, refers generally to an electronic document or file (e.g., pdf file, monitor display), as well as a tangible document (e.g., paper report). A subject report can be completely or partially electronically generated, e.g., presented on an electronic display (e.g., computer monitor).

The method results in the report can include, for example, one or more of the amount of the diagnostic miRNA assayed. The level can be reported as a quantitative score (e.g., a concentration, e.g., pg/ml serum) and/or a semi-quantitative score (e.g., a score reflecting an amount of a biomarker relative to a control level or a selected threshold level). The method results can optionally include assay results for a control biomarker.

Reports can include information such as a predicted risk that the patient has or will develop an adverse prostate cancer pathology.

Reports can include guidance to a clinician as to a treatment recommendation for the subject based on the likelihood of adverse prostate cancer pathology in a subject. For example, reports can include a recommendation regarding further evaluation and/or avoiding expensive and invasive evaluations and/or a recommendations regarding therapeutic intervention (e.g., administering a drug, recommending surgical intervention, etc.), modifying a treatment regimen (e.g., adjusting a drug dose (e.g., increasing or decreasing a dose), adjusting a dosage regimen (e.g., increasing or decreasing dose frequency and/or amount), and the like.

A report can further include one or more of: 1) patient information (e.g., name, medical information (e.g., age, gender, symptoms (e.g., symptoms that may be relevant to diagnosis of prostate cancer), etc.), 2) information about the biological sample (e.g., type, when obtained); 3) information regarding where and how the assay was performed (e.g., testing facility, assay format); 4) service provider information; and/or 5) an interpretive report, which can provide a narrative providing an at least partial interpretation of the results so as to facilitate a diagnosis by a clinician.

Accordingly, the methods disclosed herein can further include a step of generating or outputting a report providing the method results and, optionally, other information such as treatment guidance as described herein. The report can be provided in the form of an electronic medium (e.g., an electronic display on a computer monitor), or in the form of a tangible medium (e.g., a report printed on paper or other tangible medium). An assessment as to the likelihood can be referred to as "risk report" or, simply, a "diagnostic result". The person or entity that prepares a report ("report generator") may also perform steps such as sample gathering, sample processing, and the like. Alternatively, an entity other than the report generator can perform steps such as sample gathering, sample processing, and the like. A report can be provided to a user. A "user" can be, for example, a health professional (e.g., a clinician, a laboratory technician, a physician, etc.).

Computer-Implemented Methods, Systems and Devices

The methods of the present disclosure can be computer-implemented, such that method steps (e.g., assaying, comparing, calculating, and the like) are be automated in whole or in part. Accordingly, the present disclosure provides methods, computer systems, devices and the like in connection with computer-implemented methods of determining a likelihood of adverse prostate cancer pathology in a subject.

For example, the method steps, including obtaining values for the diagnostic miRNA(s), comparing diagnostic miRNA amount(s) to a reference amount, generating a report, and the like, can be completely or partially performed by a computer program product. Values obtained can be stored electronically, e.g., in a database, and can be subjected to an algorithm executed by a programmed computer.

For example, the methods of the present disclosure can involve inputting the amount of a diagnostic miRNA (e.g., an amount of mir-19a, mir-19b, mir-519c-5p, and/or mir-345) into a computer programmed to execute an algorithm to perform the comparing step described herein, and generate a report as described herein, e.g., by displaying or printing a report to an output device at a location local or remote to the computer.

The present invention thus provides a computer program product including a computer readable storage medium having a computer program stored on it. The program can, when read by a computer, execute relevant calculations based on values obtained from analysis of one or more biological sample from an individual. The computer program product has stored therein a computer program for performing the calculation(s).

The present disclosure provides systems for executing the program described above, which system generally includes: a) a central computing environment; b) an input device, operatively connected to the computing environment, to receive patient data, wherein the patient data can include, for example, biomarker level or other value obtained from an assay using a biological sample from the patient, as described above; c) an output device, connected to the computing environment, to provide information to a user (e.g., medical personnel); and d) an algorithm executed by the central computing environment (e.g., a processor), where the algorithm is executed based on the data received by the input device, and wherein the algorithm calculates a value, which value is indicative of the likelihood the subject has an adverse prostate cancer pathology, as described herein.

Computer Systems

The present disclosure also provides computer systems for determining a likelihood of adverse prostate cancer pathology in a subject. The computer systems include a processor and memory operably coupled to the processor, where the memory programs the processor to receive assay data including an amount of at least one diagnostic miRNA in a biological sample from a subject; compare the amount received with a reference amount; and calculate a likelihood of adverse prostate cancer pathology in the subject, based on results of said comparing the determined amounts obtained from the analyzing unit with the reference amount. In certain aspects, the system calculates a likelihood of adverse prostate cancer pathology in the subject based on one or more additional risk factors, such as the subject's age, PSA level, etc.

Computer systems may include a processing system, which generally comprises at least one processor or processing unit or plurality of processors, memory, at least one input device and at least one output device, coupled together via a bus or group of buses. In certain embodiments, an input device and output device can be the same device. The memory can be any form of memory device, for example, volatile or non-volatile memory, solid state storage devices, magnetic devices, etc. The processor can comprise more than one distinct processing device, for example to handle different functions within the processing system.

An input device receives input data and can comprise, for example, a keyboard, a pointer device such as a pen-like device or a mouse, audio receiving device for voice controlled activation such as a microphone, data receiver or antenna such as a modem or wireless data adaptor, data acquisition card, etc. Input data can come from different sources, for example keyboard instructions in conjunction with data received via a network.

Output devices produce or generate output data and can comprise, for example, a display device or monitor in which case output data is visual, a printer in which case output data is printed, a port for example a USB port, a peripheral component adaptor, a data transmitter or antenna such as a modem or wireless network adaptor, etc. Output data can be distinct and derived from different output devices, for example a visual display on a monitor in conjunction with data transmitted to a network. A user can view data output, or an interpretation of the data output, on, for example, a monitor or using a printer. The storage device can be any form of data or information storage means, for example, volatile or non-volatile memory, solid state storage devices, magnetic devices, etc.

In use, the processing system may be adapted to allow data or information to be stored in and/or retrieved from, via wired or wireless communication means, at least one database. The interface may allow wired and/or wireless communication between the processing unit and peripheral components that may serve a specialized purpose. In general, the processor can receive instructions as input data via input device and can display processed results or other output to a user by utilizing output device. More than one input device and/or output device can be provided. A processing system may be any suitable form of terminal, server, specialized hardware, or the like.

A processing system may be a part of a networked communications system. A processing system can connect to a network, for example the Internet or a WAN. Input data and output data can be communicated to other devices via the network. The transfer of information and/or data over the network can be achieved using wired communications means or wireless communications means. A server can facilitate the transfer of data between the network and one or more databases. A server and one or more databases provide an example of an information source.

Thus, a processing computing system environment may operate in a networked environment using logical connections to one or more remote computers. The remote computer may be a personal computer, a server, a router, a network PC, a peer device, or other common network node, and typically includes many or all of the elements described above.

Certain embodiments may be described with reference to acts and symbolic representations of operations that are performed by one or more computing devices. As such, it will be understood that such acts and operations, which are at times referred to as being computer-executed, include the manipulation by the processor of the computer of electrical signals representing data in a structured form. This manipulation transforms the data or maintains them at locations in the memory system of the computer, which reconfigures or otherwise alters the operation of the computer in a manner understood by those skilled in the art. The data structures in which data is maintained are physical locations of the memory that have particular properties defined by the format of the data. However, while an embodiment is being described in the foregoing context, it is not meant to be limiting as those of skill in the art will appreciate that the acts and operations described hereinafter may also be implemented in hardware.

Embodiments may be implemented with numerous other general-purpose or special-purpose computing devices and computing system environments or configurations. Examples of well-known computing systems, environments, and configurations that may be suitable for use with an embodiment include, but are not limited to, personal computers, handheld or laptop devices, personal digital assistants, multiprocessor systems, microprocessor-based systems, programmable consumer electronics, network, minicomputers, server computers, web server computers, mainframe computers, and distributed computing environments that include any of the above systems or devices.

Embodiments may be described in a general context of computer-executable instructions, such as program modules, being executed by a computer. Generally, program modules include routines, programs, objects, components, data structures, etc., that perform particular tasks or implement particular abstract data types. An embodiment may also be practiced in a distributed computing environment where tasks are performed by remote processing devices that are linked through a communications network. In a distributed computing environment, program modules may be located in both local and remote computer storage media including memory storage devices.

Computer Program Products

The present disclosure provides computer program products that, when executed on a programmable computer such as that described above, can carry out the methods of the present disclosure. As discussed above, the subject matter described herein may be embodied in systems, apparatus, methods, and/or articles depending on the desired configuration. These various implementations may include implementation in one or more computer programs that are executable and/or interpretable on a programmable system including at least one programmable processor, which may be special or general purpose, coupled to receive data and instructions from, and to transmit data and instructions to, a storage system, at least one input device (e.g. video camera, microphone, joystick, keyboard, and/or mouse), and at least one output device (e.g. display monitor, printer, etc.).

Computer programs (also known as programs, software, software applications, applications, components, or code) include instructions for a programmable processor, and may be implemented in a high-level procedural and/or object-oriented programming language, and/or in assembly/machine language. As used herein, the term "machine-readable medium" refers to any computer program product, apparatus and/or device (e.g., magnetic discs, optical disks, memory, etc.) used to provide machine instructions and/or data to a programmable processor, including a machine-readable medium that receives machine instructions as a machine-readable signal.

It will be apparent from this description that aspects of the present invention may be embodied, at least in part, in software, hardware, firmware, or any combination thereof. Thus, the techniques described herein are not limited to any specific combination of hardware circuitry and/or software, or to any particular source for the instructions executed by a computer or other data processing system. Rather, these techniques may be carried out in a computer system or other data processing system in response to one or more processors, such as a microprocessor, executing sequences of instructions stored in memory or other computer-readable medium including any type of ROM, RAM, cache memory, network memory, floppy disks, hard drive disk (HDD), solid-state devices (SSD), optical disk, CD-ROM, and magnetic-optical disk, EPROMs, EEPROMs, flash memory, or any other type of media suitable for storing instructions in electronic format.

In addition, the processor(s) may be, or may include, one or more programmable general-purpose or special-purpose microprocessors, digital signal processors (DSPs), programmable controllers, application specific integrated circuits (ASICs), programmable logic devices (PLDs), trusted platform modules (TPMs), or the like, or a combination of such devices. In alternative embodiments, special-purpose hardware such as logic circuits or other hardwired circuitry may be used in combination with software instructions to implement the techniques described herein.

Examples of Applications of Method Results

The methods of the present disclosure can provide results which can then be applied to facilitate decisions as to the care of the subject. Examples are provided below.

Assay-Guided Therapy and Monitoring of Therapy

The methods of the present disclosure can help a clinician in making a treatment decision for the subject, e.g., whether the results of the method suggest the subject may or may not benefit from invasive therapeutic intervention for treatment of prostate cancer. For example, based on the method results, a therapy can be selected for the subject based on the likelihood he has or is at risk of having an adverse prostate cancer pathology. Clinical signs, symptoms and other factors such as family history can also be considered to facilitate selecting a therapy.

The method results can guide a clinician as to whether or not any therapy for treatment of prostate cancer should be administered.

The methods of the present disclosure can facilitate monitoring therapy of a subject undergoing treatment for prostate cancer, such as watchful waiting, active surveillance, and the like. For example, where the subject is already receiving a therapy, the method can provide a method of monitoring therapy. In this case, the method results can guide a clinician in adjusting therapy (e.g., whether or not to continue therapy (e.g., so as to avoid relapse), increase or decrease dose, change therapy regimen (e.g., from monotherapy to combination therapy, or from non-surgical therapy to surgical therapy) where the patient is not receiving adequate therapeutic benefit (e.g., the patient is not responding to therapy), and the like). Such methods of monitoring therapy are useful in guiding further treatment decisions, such as whether continued administration of a drug regimen indicated, or whether the patient should receive a radical prostatectomy. The methods of monitoring therapy using the algorithms of the present disclosure may be used in combination with other methods for assessing whether a subject responds to therapy (is a "responder") or is not exhibiting a sufficient therapeutically beneficial response (is as "non-responder").

Identifying Subjects for Clinical Trial Populations

The methods of the present disclosure find use in identifying subjects suitable for inclusion or exclusion in a clinical trial based on upon the likelihood the subject has adverse prostate cancer pathology. For example, the methods of the present disclosure can be used to identify subjects suitable for inclusion in a clinical trial to assess efficacy of active surveillance on subjects that do not have adverse prostate cancer pathology, so that subjects that have adverse prostate cancer pathology are excluded. In another example, the methods of the present disclosure can be used to identify subjects having adverse prostate cancer pathology so as to exclude such subjects from a clinical trial (e.g., where the clinical trial is to assess efficacy of a drug for prostate cancer in subjects without adverse prostate cancer pathology). In another example, the methods of the present disclosure can be used to identify subjects suitable for inclusion in a clinical trial. Accordingly, such methods can facilitate identification of drugs or other therapies for treatment of prostate cancer in subjects with or without adverse prostate cancer pathology.

Kits

Kits of the present disclosure can include a detection agent(s) for one or more, two or more, three or more, or four or more diagnostic miRNAs. As used herein, a "detection reagent" refers to a binding partner for a biomarker that is suitable for use in detection of a biomarker, and is optionally detectably labeled. Detection agent(s) for one or more reference miRNA(s) can also be included. Kits can include one or more devices, computer systems, devices and the like, including such devices and computer systems as described herein.

Kits can include instructions for using the components of the kit to practice a method of the present disclosure. The instructions are generally recorded on a suitable recording medium, such as paper, plastic, electronic storage, medium, and the like. For example, the instructions may be present in the kits as a package insert, in the labeling of the container of the kit or components thereof (e.g., associated with the packaging or sub-packaging), etc. In other embodiments, the instructions are present as an electronic storage data file present on a suitable computer readable storage medium, e.g. compact disc-read only memory (CD-ROM), digital versatile disk (DVD), diskette, etc. In other examples, the instructions provided do not contain many or all assay details, but rather provide direction as to a remote source for obtaining detailed instructions, e.g. via the internet.

EXAMPLES

As can be appreciated from the disclosure provided above, the present disclosure has a wide variety of applications. Accordingly, the following examples are put forth so as to provide those of ordinary skill in the art with a complete disclosure and description of how to make and use the present invention, and are not intended to limit the scope of what the inventors regard as their invention nor are they intended to represent that the experiments below are all or the only experiments performed. Those of skill in the art will readily recognize a variety of noncritical parameters that could be changed or modified to yield essentially similar results. Thus, the following examples are put forth so as to provide those of ordinary skill in the art with a complete disclosure and description of how to make and use the present invention, and are not intended to limit the scope of what the inventors regard as their invention nor are they intended to represent that the experiments below are all or the only experiments performed. Efforts have been made to ensure accuracy with respect to numbers used (e.g. amounts, dimensions, etc.) but some experimental errors and deviations should be accounted for.

Materials and Methods

The following are general materials and protocols used in the Examples below.

Study Design and Sample Collection

A schematic of the study design is depicted in FIG. 1. The study design followed the principle of prospective specimen collection and retrospective blinded evaluation (PRoBE) design. Serum and tissue samples were collected with informed consent from UCSF radical prostatectomy patients under institutional review board supervision and stored in the UCSF tissue core. Serum samples were collected at the time of surgery after induction of anesthesia but prior to any procedural intervention and stored at −80° C. until use. Formalin-fixed, paraffin-embedded (FFPE) radical prostatectomy tissue blocks were archived and available for analysis.

Patient Cohorts

Patients included in the study met the UCSF low-risk criteria for AS including biopsy Gleason 2-6 (no pattern 4 or 5), PSA less than 10 ng/ml, less than 33% of biopsy cores involved, less than 50% involvement in any single core, and clinical T1-T2 stage disease. All selected patients chose to undergo immediate radical prostatectomy. A Gleason score of 7 of higher was used to define adverse prostate cancer pathology.

The discovery cohort consisted of 48 patients with a post-surgical specimen Gleason score ≥7 (case group) and 48 patients with a post-surgical specimen Gleason score of 6 (control group). A validation cohort consisted of 46 patients in case and 50 25 patients in control group.

Detection of miRNAs miRNAs were detected using a microfluidic-based multiplex qRT-PCR method as described in Moltzahn, et al. (2010) Cancer Res. 71:550-560 and Moltzahn et al. (2011) J. Vis. Exp. 2011 Aug. 3(54), the disclosures of which are incorporated herein by reference. Briefly, total RNA was extracted from serum samples (300 µl) using the mirVana PARIS kit (Ambion) and concentrated using Amicon Ultra 0.5 3K centrifugal filter devices (Milipore). Multiplex reverse transcription reactions were performed on extracted RNA using stem-loop primers. The reverse transcription products were amplified utilizing unique forward primers and a universal reverse primer. Purification of the pre-PCR product was performed using the MinElute PCR purification kit (Qiagen). High throughput qPCR was performed on the purified product using a 96.96 Dynamic Array (Fluidigm). qPCR assays included individual forward primers, individual Taqman probes, and a universal reverse primer. The arrays were run on the BioMark system (Fluidigm). Libraries for 672 stem-loop primers, forward primers, and Taqman probes representing most known human miRNAs sequences were utilized (FIG. 19). Each array evaluated the expression of 96 miRNAs for 96 samples. A total of 7 arrays were performed on the discovery cohort (672 miRNA assays). One array was performed on the validation cohort focusing on those miRNAs detected in the discovery cohort.

Threshold cycle (Ct) values and amplification plots were obtained from proprietary software on the BioMark system (Fluidigm). Ct values were confirmed through quality analysis of amplification plots. miRNAs with a high Ct value (Ct>30) in >70% of the samples were deemed undetected and excluded from the analysis. Normalization was performed to the median Ct value of all detected miRNAs for each individual patient, resulting in a ΔCT value. The identity of the samples was masked until ΔCT values were obtained.

Statistical Analysis

Initial exploratory analyses compared distributions of normalized ΔCt values from miRNAs between cases and controls in the discovery sample, using graphical summaries and the Wilcoxon rank-sum test to assess significance. Models were developed for prediction of disease status using miRNAs with detectable normalized ΔCt values. Logistic regression models were initially fitted to candidate miRNAs singly, adjusting for age, PSA, and stage. Observed values for these miRNAs that exceeded the limit of detection were set at the limit. Candidate miRNAs were included in models both as continuous measures, and as binary categorical variables. Cut-off values for the latter were determined using separate classification tree models for each miRNA. An alternate cut-off defined by the median value among detectable values for each measure was also considered. Prediction performance of models was distinguished using receiver operating characteristic (ROC) area under the curve (AUC) values. A separate analysis based on a random forest classification model—as described in Hothron, et al. (2006) *J. Comp. and Graph. Stat.* 15: 651-674; the disclosure of which is incorporated herein by reference—was also conducted including all detectable miRNAs as well as age, PSA, and stage as predictors. The results of these analyses were used to provide an independent assessment of variable importance, and for confirmation of results from the simpler logistic models.

Confirmatory analyses were performed using the validation sample, and were based on the subset of miRNAs with detectable values that were also detectable in the discovery cohort. Because normalization procedures were performed separately in the two cohorts, ΔCt values for a given miRNA differed somewhat between groups. Therefore, prediction models developed in the validation sample could not be applied directly to predict outcomes among validation cases and controls. For this reason, validation analyses focused on assessing consistency of findings between the two cohorts by applying the same analytic approaches in each. Results were compared in terms of ROC assessments and variable importance rankings. In addition, the use of miRNAs to supplement the CAPRA score—as described in Cooperberg, et al. (2005) *J. Urol.* 173(6):1938-1942; the disclosure of which is incorporated herein by reference—as an index of disease risk was investigated. All statistical analyses were performed using R (version 2.15) and Stata (version 12.1).

In Situ Hybridizations

For in situ hybridizations, sections (5 μm) of FFPE patient tumor samples were stained using double DIG-labeled locked-nucleic acid (LNA) probes (Exiqon). Briefly, slides were deparaffinized, hydrated, proteinase K treated and then hybridized overnight to denatured probes at 54° C. in situ hybridization buffer (Enzo Life Sciences). Slides were washed in decreasing SSC concentrations, blocked, incubated with AP-conjugated anti-DIG (Roche), stained with BM Purple AP substrate (Roche), and counter stained with Nuclear-Fast Red (Vector). The pathologist who evaluated and graded the slides was blinded to patient diagnosis.

Example 1: Detection of Serum miRNAs Using Multiplex qRT-PCR

Multiplex qRT-PCR on a microfluidics platform provides an accurate and reliable approach for detecting serum miRNAs. This method was used to evaluate 672 miRNAs in serum of 96 patients with pre-surgical low risk disease (PSA<10, Gleason<7 with no 4+2, clinical stage <T3), but chose surgery over AS. Upon post-surgical pathological evaluation of the prostates, half of these patients had confirmed Gleason 6 ('control') while the other half were upgraded to Gleason 7 ('case'). Clinical characteristics of the patients are summarized in FIG. 2. Notably, there were no statistically significant differences in race, PSA, or clinical stage between the case and control groups. The case group did have a significantly higher age than the control group (p=0.009).

Detectable Ct values were demonstrated for 36 of the 672 miRNAs in at least 70% of the patients (FIG. 3). Many miRNAs exist as clusters, where two or more miRNAs are produced from a single transcript. Interestingly, nine of the 36 miRNAs detected in the serum of the discovery cohort are members of a single cluster, the miR17-92 cluster. MiRNAs are also grouped into families based on a common sequence at their 5' end called the seed sequence. This seed sequence largely determines the downstream messenger RNA targets of the miRNAs. Therefore, miRNAs with common seed sequence have many overlapping targets. miR-17, miR-20a, miR-92a, and miR-106a are all part of one family. Having multiple miRNAs from a single family supports a functional role for these miRNAs in these patients.

Example 2: Comparison of miRNA Serum Levels Between Case and Control Groups of the Discovery Cohort The serum levels of the detected miRNAs were compared between the case and control groups of the discovery cohort. Four of the detected miRNAs demonstrated differences in serum levels between the cases and controls. Mir-19b and mir-19a had significantly lower ΔCt values in the case group when compared to the controls (FIG. 4, Panels A-B; p=0.008 and p=0.023, respectively 2), showing higher serum expression in the case group. Conversely, mir-519c-5p and mir-345 had significantly higher ΔCt values in the case group when compared to the controls (FIG. 4, Panels C-D; p=0.013 and p=0.008, respectively), showing lower serum expression in the case group.

Figures 6, 7:
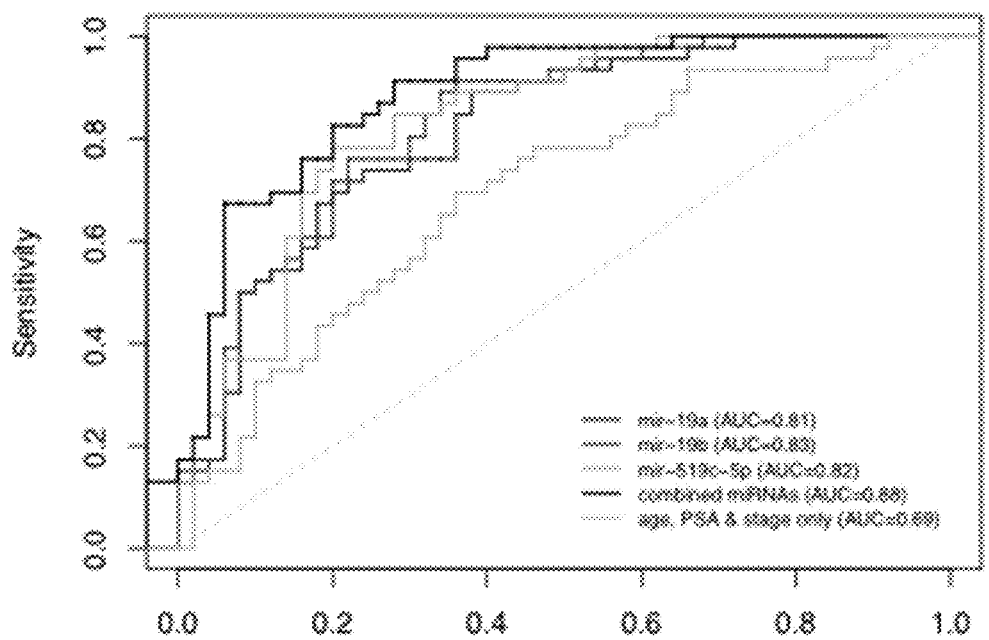
FIG. 6, Panels A-B are tables providing summaries of logistic regression models for individual miRNAs in the discovery (Panel A) and validation cohorts (Panel B).
FIG. 7 depicts ability of miRNAs to predict significant disease. ROC curves were constructed based on logistic regression models adjusting for age, stage and PSA. When used individually, mir-19b demonstrated reasonably good discriminatory ability with an AUC value of 0.83. Mir-19a and mir-519c-5p each showed similar discriminatory ability with AUC values of 0.82 and 0.81, respectively. The confirmed miRNAs each demonstrated improved predictive ability compared to the model including only age, PSA, and stage (which had an AUC value of 0.69). Furthermore, when the all three miRNAs were added to the model including these clinical characteristics, the AUC value improved to 0.88, showing additional value over current prediction tools.

Logistic regression models for predicting case/control status based on single miRNAs represented as binary indicators confirmed the significance results stated above, and these four miRNAs remained significant predictors of outcome status even when controlling for age, PSA, and disease stage (FIG. 6, Panel A). Results were not sensitive to whether miRNAs were included in prediction models as continuous variables, or as binary indicators based on median detectable levels. A nonparametric random forest classification including all detectable miRNAs as well as age, PSA, and disease stage ranked the following predictor variables as the five most important (in descending order): age, mir-19b, mir-519c-5p, mir-345 and mir-19a. None of the remaining miRNAs were significantly associated with outcome status.

Example 3: Comparison of miRNA Serum Levels Between Case and Control Groups of a Validation Cohort A validation study was performed to measure the altered microRNAs in an independent cohort with similar clinical and pathological characteristics to the discovery cohort. The patient characteristics for the validation cohort are summarized in FIG. 2. Similar to the discovery cohort, there were no statistically significant differences in race, PSA, or clinical stage between cases and controls. However, the case group was significantly older than the control group (p=0.002).

Figure 5:
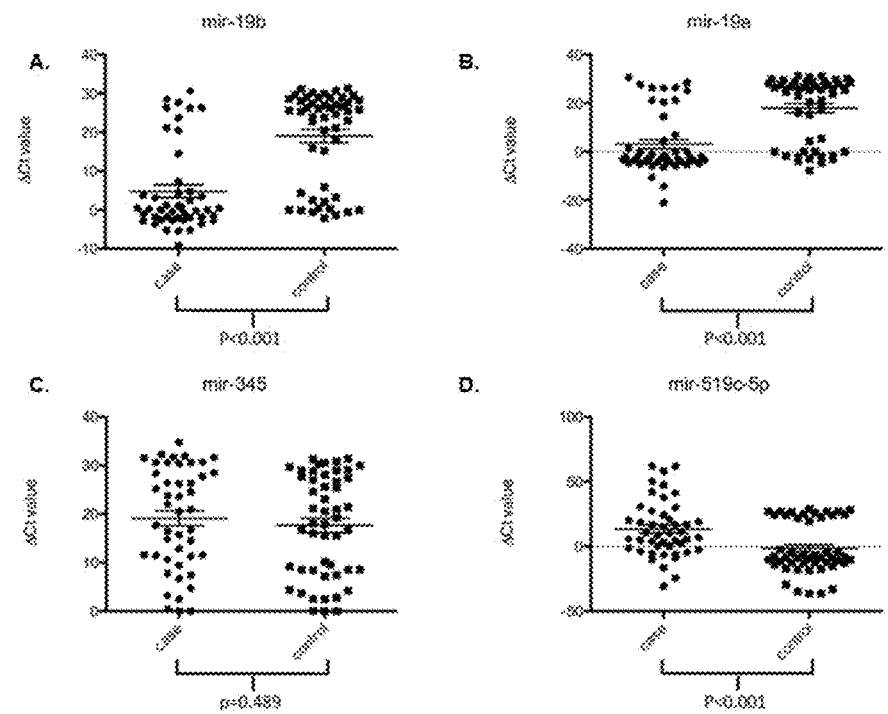
FIG. 5, Panels A-D depict miRNAs with differences in serum from the validation cohort. As seen in the discovery cohort, mir-19b (Panel A) and mir-19a (Panel B) showed significantly lower ΔCt values in the case group compared to the controls (p<0.001 for each). Indeed, the differences were even more striking in the validation cohort, likely due to normalization to the 36 expressed miRNAs rather than the 672 miRNAs measured in the discovery cohort. Serum levels of mir-519c-5p were also consistent with the previous results, showing significantly higher ΔCt values in the case group (Panel D; p<0.001). While the ΔCt values for mir-345 were similar to the results in the discovery cohort, the differences found between the cases and controls were not statistically significant (Panel C; p=0.489).

For the validation cohort, only those miRNAs found in the serum of the discovery cohort of patients (FIG. 3) were measured. As seen in the discovery cohort, mir-19b and mir-19a showed significantly lower ΔCt values in the case group compared to the controls (FIG. 5, Panels A-B; p<0.001 for each). Indeed, the differences were even more striking in the validation cohort. Serum levels of mir-519c-5p were also consistent with the previous results, showing significantly higher ΔCt values in the case group (FIG. 5, Panel D; p<0.001). While the ΔCt values for mir-345 were similar to the results in the discovery cohort, the differences found between the cases and controls were not statistically significant (FIG. 5, Panel C; p=0.489). In addition, mir-1274a, mir-92a, mir-93, mir-106a, mir-197, mir-486 and mir-720 had significantly different serum levels between cases and controls, all results that differed from those observed for the discovery cohort.

Example 4: Ability of miRNAs to Discriminate Patients with Adverse Prostate Cancer Pathology To evaluate the ability of the confirmed miRNAs to discriminate patients with adverse prostate cancer pathology, ROC curves for were constructed based on logistic regression models adjusting for age, stage and PSA (FIG. 6, Panel B, and FIG. 7). When used individually, mir-19b demonstrated reasonably good discriminatory ability with an AUC value of 0.83 (FIG. 7). Mir-19a and mir-519c-5p each showed similar discriminatory ability with AUC values of 0.81 and 0.82, respectively. The confirmed miRNAs each demonstrated improved predictive ability compared to the model including only age, PSA, and stage (which had an AUC value of 0.69). Furthermore, when the all three miRNAs were added to the model including these clinical characteristics, the AUC value improved to 0.88, showing additional value over current prediction tools.

As a further exploration of the potential for miRNAs to supplement the predictive ability of standard variables, augmenting the CAPRA score (FIG. 8, Panel A) was investigated by adding one point to the score for each of the three miRNAs observed to exceed the binary cutoff value (FIG. 8, Panel B). The resulting score displayed a significant increasing linear trend (p<0.001) in outcome risk, with 100% of the 12 individuals scored at the highest level (5) classified as cases.

Example 5: In Situ Hybridizations

Figure 9:
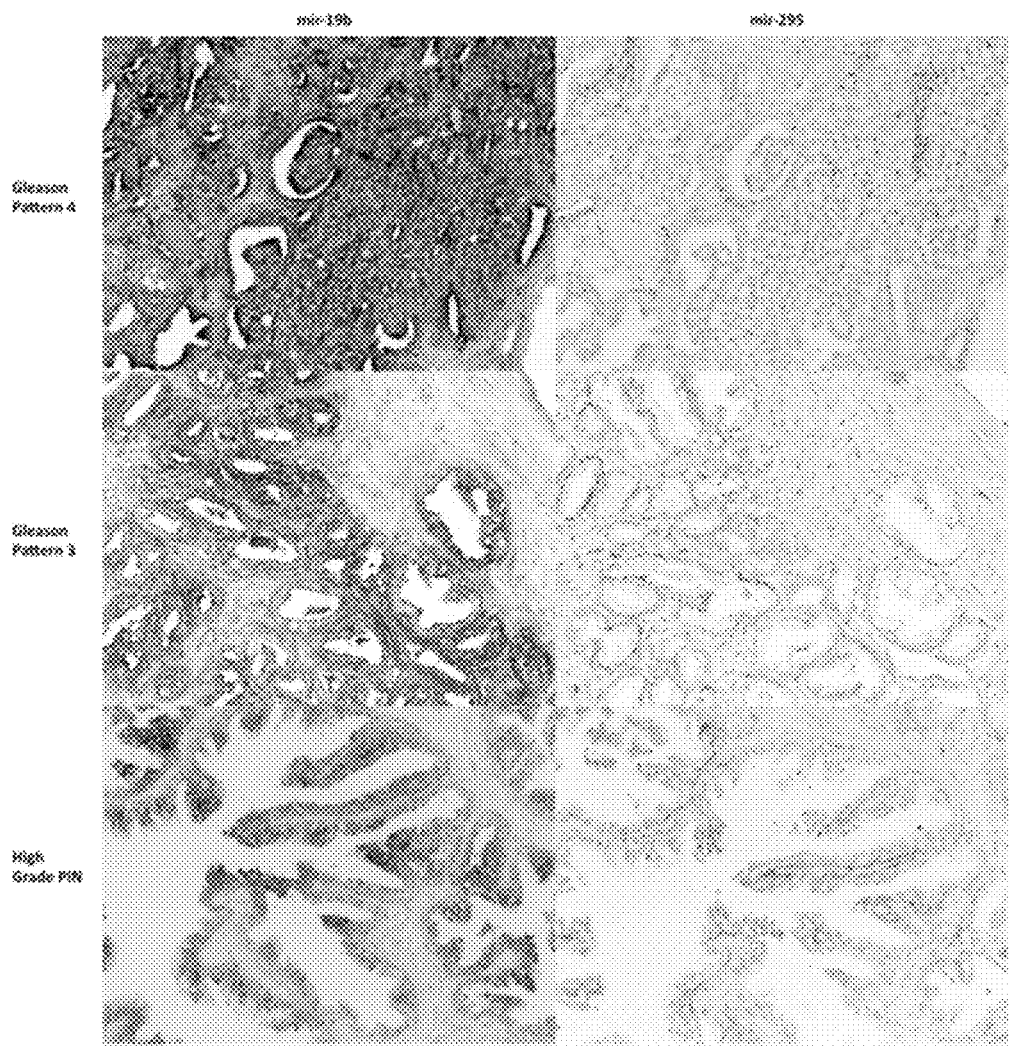
FIG. 9 depicts detection of miRNAs in patient prostate samples. In order to determine whether the predictive miRNAs are present in prostate tumors, in situ hybridizations were performed for miRNAs on FFPE tumor samples from patients in the cohort (n=10). Staining for mir-19b was detected in areas of high-grade PIN, Gleason pattern 3, and Gleason pattern 4. Areas of normal prostate epithelia and stromal tissue showed no detectable staining for mir-19b. In contrast, mir-519c-5p demonstrated variable staining in normal epithelial, abnormal prostate epithelia, and stromal tissue. There was no detectable staining for mir-295, a miRNA not expressed in human tissue.

The uncovered serum miRNAs may arise directly from the tumor or from the body's response to the tumor. In order to determine whether the predictive miRNAs are present in prostate tumors, in situ hybridizations were performed for miRNAs on FFPE tumor samples from patients in the cohort (n=10). Staining for mir-19b was detected in areas of high-grade PIN, Gleason pattern 3, and Gleason pattern 4 (FIG. 9). Areas of normal prostate epithelia and stromal tissue showed no detectable staining for mir-19b. In contrast, mir-519c-5p demonstrated variable staining in normal epithelial, abnormal prostate epithelia, and stromal tissue. There was no detectable staining for mir-295, a miRNA not expressed in human tissue (FIG. 9).

Upon completion of the study presented as Examples 1-5 above and FIGS. 1-9, it was discovered that certain samples in the validation cohort overlapped with samples in the discovery cohort due to an error at the tissue bank. To ensure the integrity of the results was not affected, a subsequent study was performed with no sample overlap. This study and the results thereof are presented as Example 6 below.

Example 6: Predicting Adverse Pathology in Prostate Cancer Patients Eligible for Active Surveillance Study Design The study design followed the principle of prospective specimen collection and retrospective blinded evaluation (PRoBE) design and reported following the REMARK guidelines. All serum samples were collected routinely at the time of surgery after induction of anesthesia but prior to any procedural intervention and stored at −80° C. until use. Formalin-fixed, paraffin-embedded (FFPE) radical prostatectomy tissue blocks were archived and available for analysis.

Figures 10, 11:
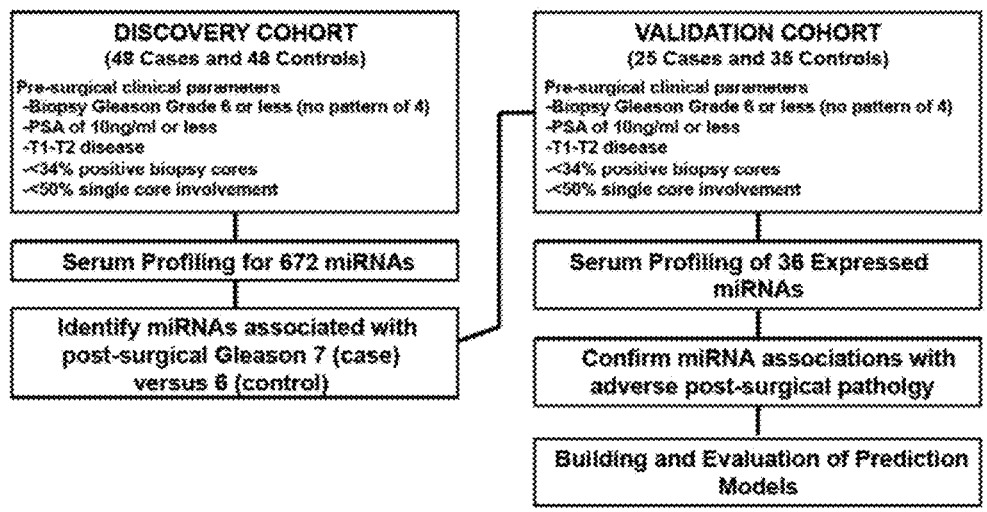
FIG. 10 is a schematic of the design of a second study. Patients met the UCSF low-risk criteria for AS including biopsy Gleason 2-6 (no pattern 4 or 5), PSA less than 10 ng/ml, less than 34% of biopsy cores involved, less than 50% involvement in any single core, and clinical T1-T2 stage disease. All selected patients chose to undergo immediate radical prostatectomy. A Gleason score of 7 of higher was used to define adverse prostate cancer pathology. The discovery cohort consisted of 48 patients with a post-surgical specimen Gleason score >7 (case group) and 48 patients with a post-surgical specimen Gleason score of 6 (control group). A validation cohort consisted of 25 patients in the case and 35 patients in the control group.
FIG. 11 is a table listing patient characteristics of the discovery and validation cohorts in the second study.

Patients included in the study were those opting for immediate radical prostatectomy who met the UCSF low-risk criteria for AS including biopsy Gleason 2-6 (no pattern 4 or 5), PSA less than 10 ng/ml, less than 34% of biopsy cores involved, less than 50% involvement in any single core, and clinical T1-T2 stage disease. A pathologic Gleason score of 7 of higher is associated with an increased risk of PCa mortality and, therefore, was used to define adverse pathology. The discovery cohort consisted of 48 patients with a post-surgical pathologic Gleason score of 7 or higher (case group) and 48 patients with a pathologic Gleason score of 6 (control group). A validation cohort consisted of 25 cases and 35 controls. Patients were chosen from available samples maintained in a UCSF tissue bank. Patients fitting criteria above were selected from the available pool based on a random integer generator. A schematic of the study design is depicted in FIG. 10.

Microfluidics-Based Multiplex qRT-PCR Profiling of miRNAs

A microfluidic-based multiplex qRT-PCR method was used to detect miRNAs as previously described. Libraries for 672 stem-loop primers, forward primers, and Taqman probes representing most known human miRNAs sequences (sequences at http://urology.ucsf.edu/blellochlab/protocols/miRNAqPCRsequences.txt) were used. Each microfluidic array evaluated the expression of 96 miRNAs for 96 samples. A total of 7 arrays were performed on the discovery cohort (672 miRNA assays). One array was performed on the validation cohort focusing only on those miRNAs detected (see below) in the discovery cohort.

Amplification plots and threshold cycle (Ct) values, a measure of the number of PCR cycles to reach a threshold line set within the exponential phase of amplification, were obtained from proprietary software on the BioMark system (Fluidigm). A higher Ct reflects lower input of measured miRNA. Ct values were confirmed through quality analysis of amplification plots. MiRNAs with a high Ct value (Ct>30) in >70% of the samples were deemed undetected and excluded from the analysis. Normalization was performed to the median Ct value of all detected miRNAs within an array for each individual patient, resulting in a ΔCT value (FIGS. 11 and 12). Normalization was performed to account for systematic variations in miRNA expression levels across individuals and arrays, so that biological differences can be more easily distinguished. However, analysis of un-normalized data, simply controlled for amount of input serum led to analogous findings. The identity of the samples was masked until ΔCT values were obtained.

Statistical Analysis

Initial analyses compared distributions of normalized ΔCT values from miRNAs between cases and controls in the discovery sample using graphical summaries and the Wilcoxon rank-sum test to assess significance. Logistic regression models were then fitted to candidate miRNAs singly, adjusting for age, PSA, stage, and degree of biopsy involvement including percent cores tumor positive and percent of total length of cores involved. Candidate miRNAs were included in models both as continuous measures, and as binary categorical variables. Cut-off values for the latter were determined using separate classification tree models or by the median for each miRNA. Both cut-offs gave similar results.

Prediction performance of models was distinguished using receiver operating characteristic (ROC) area under the curve (AUC) values. A separate analysis based on a random forest classification model was also conducted including all detectable miRNAs as well as age, PSA, stage, and degree of biopsy involvement as predictors. The results of this analysis were used to provide an independent assessment of variable importance, and for confirmation of results from the simpler logistic models.

For the validation cohort, only those miRNAs that were detected in >30% of the samples in the discovery cohort were measured. Normalizing to all detected miRNAs run on a single array changed the breadth of ΔCT values for a given miRNA, often improving differences between cases and controls. Analytic approaches described above for discovery were similarly applied in the validation cohort. Final analyses focused on miRNAs detected as significant predictors in the discovery cohort that also were significant in the validation set. Only markers with adjusted p-values (based on false discovery rate methods) of at most 0.1 in discovery analyses were considered. These were modeled singly and jointly in logistic regression models also controlling for the same characteristics considered in analyses for the discovery cohort. In addition, we investigated the use of selected miRNAs to supplement the well-validated CAPRA score as an index of disease risk as described in more detail in results.

Additional descriptive analyses were conducted to compare selected patient characteristics between the discovery and validation cohorts. Formal testing was based on Fisher's Exact test (for categorical characteristics) and the Wilcoxon rank-sum test (for quantitative characteristics).

All statistical analyses were performed using R (version 2.15) and Stata (version 12.1).

In Situ Hybridizations

Slides with sections (5 µm) of FFPE tumor samples from the patient cohort were deparaffinized in Xylene and hydrated through decreasing ethanol concentrations into PBS. The slides were then treated with 300 µl of proteinase-K (15 µg/ml in PK buffer, 5 mM Tris-HCl pH 7.4, 1 mM EDTA, 1 mM NaCl) at 37° c. in a hybridizer (Dako) for 10 minutes. After two PBS washes, the sections were dehydrated through increasing ethanol concentrations and air-dried for 15 minutes. Double DIG-labeled locked-nucleic acid (LNA) probes (Exiqon) for individual miRNAs were denatured by heating at 90° c. for 4 minutes then diluted to 40 nM using in situ hybridization buffer (Enzo Life Sciences). The sections were hybridized with 50 µl of diluted probe at 54° C. overnight then washed in decreasing SSC concentrations at hybridization temperature. Following a 5 minute incubation in 0.2×SSC at room temperature, the slides were washed in PBS and blocked with 2% blocking solution (Roche) for 15 minutes. The sections were then treated with alkaline phosphatase (AP)-conjugated anti-DIG (Roche) diluted 1:800 in blocking solution containing 2% sheep serum for 60 minutes. After two washes in AP buffer (100 mM Tris ph 9.5, 50 mM $MgCl_2$, 100 mM NaCl, 0.1% Tween-20, 2 mM levamisol), the sections were incubated in BM Purple AP substrate (Roche) in the dark at 4° C. overnight. The slides were then washed twice in PBS containing 0.1% Tween-20 and washed twice in water. Following a 30 second treatment with Nuclear-Fast Red (Vector), the slides were dehydrated though increasing ethanol concentrations then mounted. The stained slides were evaluated and graded blindly.

Results miRNA Profiling in Discovery Cohort

We aimed to determine whether miRNAs from pre-surgical serum samples could predict post-surgical pathological upgrade. Clinical characteristics of the patients in our discovery cohort are summarized in FIG. 11. Case (post-surgical Gleason 7) and control (post-surgical Gleason 6) groups had similar distributions of race and clinical characteristics. Cases were significantly older than controls (p=0.005). PSA levels also were somewhat higher in cases (p=0.07). Of the 672 miRNAs tested, 36 had Ct<30 in at least 30% of the patients, which we established as a cutoff of detection (Table 2). Many miRNAs exist as clusters, where two or more miRNAs are produced from a single transcript. Nine of the 36 miRNAs are members of a single cluster, the miR17-92 cluster. MiRNAs are also grouped into families based on a common sequence at their 5' end called the seed sequence, which largely defines their downstream targets. miR-17, miR-20a, miR-92a, and miR-106a, for example, are all part of one family. Therefore, across all these PCa patients, there was an apparent enrichment for specific clusters and families of miRNAs.

Figure 16:
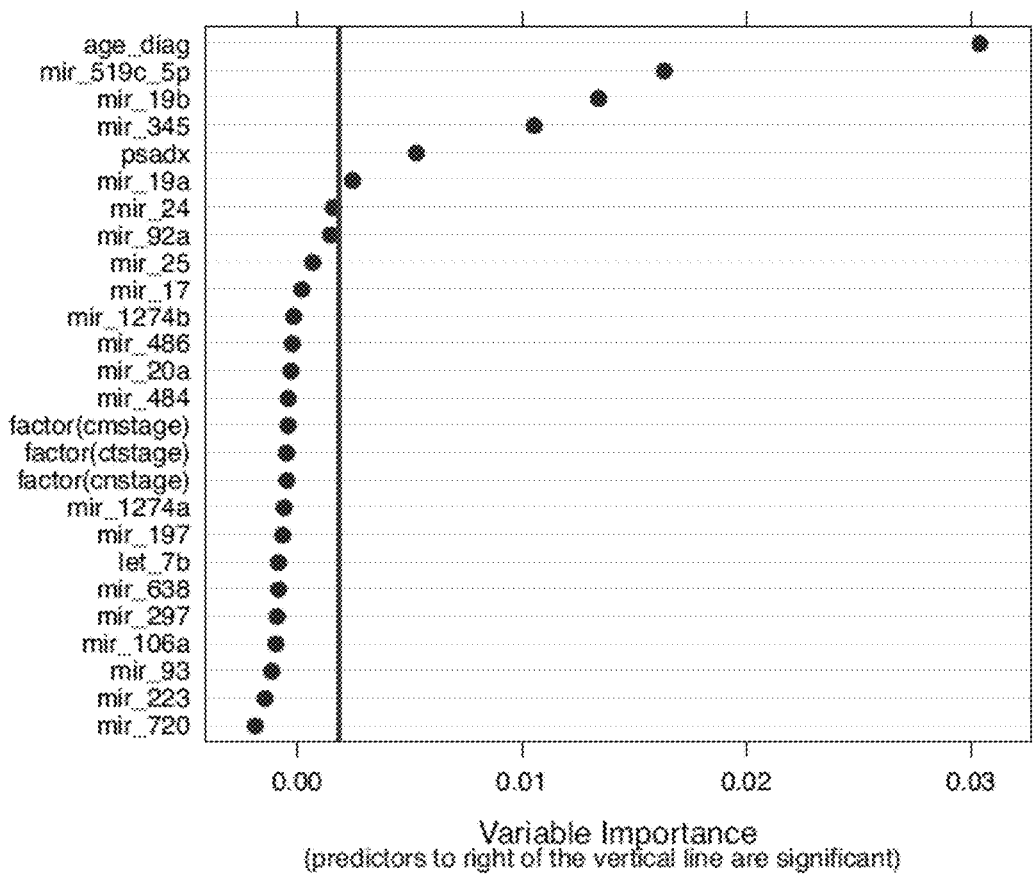
FIG. 16 shows a summary of variable importance values from a random forest model fitted to the discovery dataset. Included variables are listed on the vertical axis, with corresponding variable importance for each on the horizontal axis, Importance is determined using "conditional permutation accuracy", calculated as a the average difference in model accuracy between the fitted model and alternative versions obtained via random permutations of the variable values. Variables are considered significant predictors in the random forest if their variable importance value is above the absolute value of the lowest negative-scoring variable.

We next compared the serum levels of the 36 detected miRNAs between the case and control groups of the discovery cohort. Four of the detected miRNAs demonstrated differences in serum levels between the cases and controls. MiR-19a and miR-19b displayed lower ΔCt values in the case group compared to controls (FIG. 15, Panel A, p=0.06 and p=0.07 respectively), consistent with higher serum levels in cases. Conversely, miR-345 and miR-519c-5p had significantly higher ΔCt values in the case group when compared to the controls (FIG. 15, Panel A, p=0.04 and p=0.02 respectively), consistent with lower serum levels in the case group. Logistic regression models for predicting case/control status based on single miRNAs represented as binary indicators (with cut-off values selected using classification trees) showed all four miRNAs as highly significant predictors of outcome status (odds ratio) even when controlling for age, PSA, clinical stage, and degree of biopsy involvement (FIG. 13). Results were not sensitive to whether miRNAs were included in prediction models as continuous variables or as binary indicators based on median detectable levels (data not shown). A nonparametric random forest classifier including all detectable miRNAs (represented as continuous measures) as well as age, PSA, stage, and biopsy involvement ranked the following predictor variables as the six most important (in descending order): age, miR-519c-5p, miR_19 b, miR-345, PSA and miR_19a (FIG. 16). None of the other measured miRNAs were significantly associated with outcome status.

Validation of miRNA Signature in Independent Cohort

To confirm our miRNA associations, we performed a validation study focusing only on those miRNAs that were measure in at least 30% of patients' serum samples (FIG. 12). The patient characteristics for the validation cohort are summarized in Table 1. Similar to the discovery cohort, there were no statistically significant differences in race, or clinical stage between cases and controls, while differences in age and PSA were significant (p=0.002 and 0.04 respectively). As seen in the discovery cohort, miR-19b and miR-19a showed significantly lower ΔCt values in the case group compared to the controls (FIG. 15, Panel B). Indeed, the differences were even more striking in the validation cohort (p<0.001 for both), likely due to normalization based on all detected miRNAs on a single array (versus spread across multiple arrays in discovery cohort). Serum levels of miR-519c-5p were also consistent with the previous results, showing significantly higher ΔCt values in the case group (FIG. 15, Panel B, p=0.0022). While the ΔCt values for miR-345 were similar to the results in the discovery cohort, the differences found between the cases and controls were not statistically significant (FIG. 15, Panel B, p=0.3536). However, in models adjusting for age and PSA, miR-345 remained highly significant when included as a binary predictor (see below).

Prognostic Value of Three-miRNA Signature

To evaluate the ability of the confirmed miRNAs to discriminate patients with adverse pathology in the validation set, they were included in logistic regression models also adjusting for age, stage, PSA, and extent of biopsy involvement. When considered individually, all four miRNAs showed strong associations with case status, with odds ratios of 9.22, 12.67, 0.03 and 0.06 (p values <0.01) (FIG. 13). Furthermore they individually showed improved discriminatory ability with AUCs of 0.85, 0.86, 0.84, and 0.88 relative to an AUC of 0.77 for a model including only age, PSA, stage, and biopsy involvement, with miR-519c-5p yielding a statistically significant improvement at the 5% level (FIG. 13). Next we evaluated models using different combinations of the miRNAs (FIG. 14). Notably, miR-19a and miR-19b appeared to be co-dependent, consistent with the fact that they are expressed from a common transcript, miR-17-92. Remarkably, models consisting of a combination either miR-19a or miR-19b together with miR-345 and miR-519c-5p showed a AUC of 0.94 (p=0.007 and 0.009 respectively) (FIG. 14 and FIG. 17, Panel A).

In order to identify a scoring mechanism accessible to physicians and their patients, we evaluated the utility of adding miRNA values to an established risk model, the CAPRA score. Notably, our cohort had low CAPRA scores (ranging from 0-2 out of 10) as expected for AS-eligible patients. By adding one point to the score for each of the three miRNAs (miR-19a or 19b, miR-345, and miR-519c-5p) that was observed to exceed the binary cutoff value, patients could be separated into those likely to have Gleason 7—and hence intermediate risk—disease versus those that did not (FIG. 17, Panels B and C). The linear trend was highly significant (p<0.001). Indeed, 100% of patients (n=13) with a score of 4 or 5 had Gleason 7 disease post-surgically versus 2 out of 31 of patients with scores of 1 or 2.

Origin of Serum miRNAs

Figure 18:
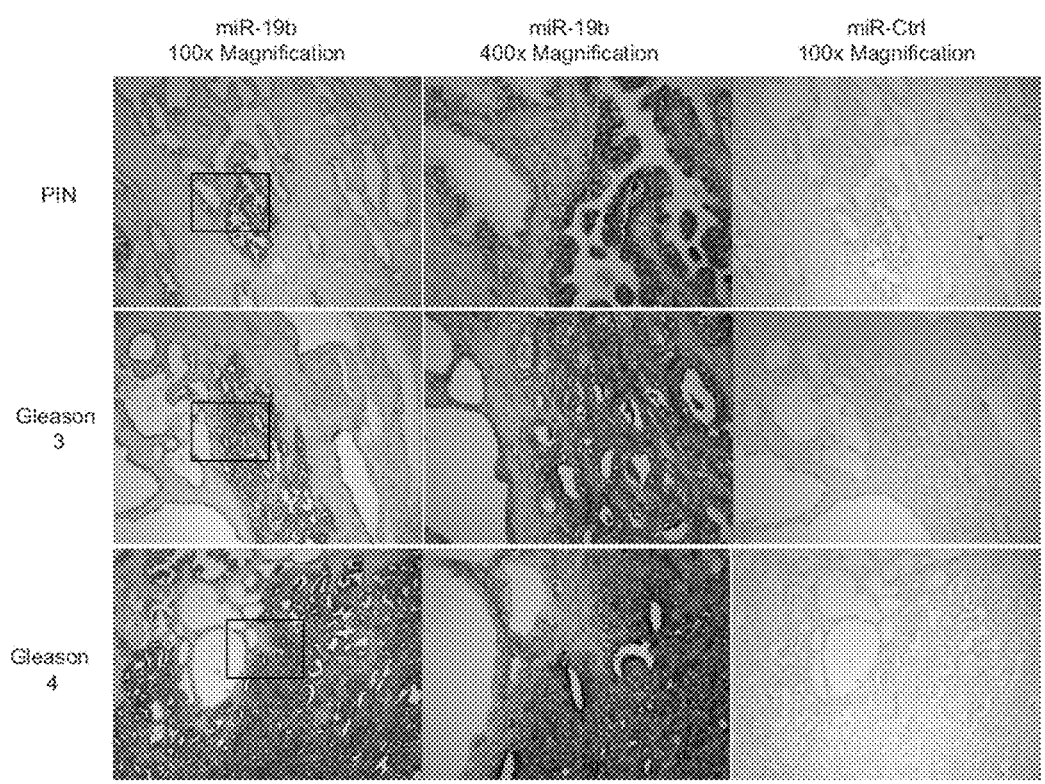
FIG. 18 shows staining for miR-19b in patient tumor samples. Images show in situ hybridization staining for miR-19b (left and center panels) and negative control, miR-295 (right panels). Top panels show area of prostate intraepithelial neoplasia (PIN). Middle panels show area of Gleason 3. Bottom panels show area of Gleason 4. Areas of PIN, Gleason 3, and Gleason 4 all stain strongly for miR-19b probe (blue staining). Note each panel has area of normal-appearing epithelium, most clearly seen on the left of each center panel. These areas show much lower staining. Right and left panels, 100× magnification. Center panels, 400× magnification. Center panels represent boxed areas in left panels.

The uncovered serum miRNAs may arise directly from the tumor or from the body's response to the tumor. In order to determine whether the predictive miRNAs are present in prostate tumors, we performed in situ hybridizations with probes for miR-19b and miR-519c-5p on FFPE tumor samples from patients in our cohort (n=10). Staining for miR-19b was strong in areas of high-grade PIN, Gleason pattern 3, and Gleason pattern 4, but absent in normal appearing epithelium (FIG. 18). However, there was no obvious difference in intensity of staining with increasing grade from PIN to Gleason pattern 4. In contrast, miR-519c-5p demonstrated variable staining in normal epithelial, abnormal prostate epithelia, and stromal tissue. In summary, while miR-19 cellular levels clearly increased with transformation, it was unclear if there was any further increase within the cells with pathological progression.

In conclusion, this study identifies for the first time a serum miRNA signature that can act as an independent prognostic marker in PCa. Furthermore, it shows how serum miRNAs can be used to identify relatively small steps in tumor progression allowing increasing clinical refinement of disease status.

Although the foregoing invention has been described in some detail by way of illustration and example for purposes of clarity of understanding, it is readily apparent to those of ordinary skill in the art in light of the teachings of this invention that certain changes and modifications may be made thereto without departing from the spirit or scope of the appended claims. It is also to be understood that the terminology used herein is for the purpose of describing particular embodiments only, and is not intended to be limiting, since the scope of the present invention will be limited only by the appended claims.

Accordingly, the preceding merely illustrates the principles of the invention. It will be appreciated that those skilled in the art will be able to devise various arrangements which, although not explicitly described or shown herein, embody the principles of the invention and are included within its spirit and scope. Furthermore, all examples and conditional language recited herein are principally intended to aid the reader in understanding the principles of the invention and the concepts contributed by the inventors to furthering the art, and are to be construed as being without limitation to such specifically recited examples and conditions. Moreover, all statements herein reciting principles, aspects, and embodiments of the invention as well as specific examples thereof, are intended to encompass both structural and functional equivalents thereof. Additionally, it is intended that such equivalents include both currently known equivalents and equivalents developed in the future, i.e., any elements developed that perform the same function, regardless of structure. The scope of the present invention, therefore, is not intended to be limited to the exemplary embodiments shown and described herein. Rather, the scope and spirit of present invention is embodied by the appended claims.

SEQUENCE LISTING (2846 sequences)

SEQ ID NO: 1 - DNA, 44 bp, Artificial sequence
  Synthetic nucleic acid sequence
ctcaactggtgtcgtggagtcggcaattcagttgagaactatac

SEQ ID NO: 2 - DNA, 44 bp, Artificial sequence
  Synthetic nucleic acid sequence
ctcaactggtgtcgtggagtcggcaattcagttgagaaccacac

SEQ ID NO: 3 - DNA, 44 bp, Artificial sequence
  Synthetic nucleic acid sequence
ctcaactggtgtcgtggagtcggcaattcagttgagaaccatac

SEQ ID NO: 4 - DNA, 44 bp, Artificial sequence
  Synthetic nucleic acid sequence
ctcaactggtgtcgtggagtcggcaattcagttgagaactatgc

SEQ ID NO: 5 - DNA, 44 bp, Artificial sequence; identical to SEQ ID NO: 1
  Synthetic nucleic acid sequence

SEQ ID NO: 6 - DNA, 44 bp, Artificial sequence; identical to SEQ ID NO: 1
  Synthetic nucleic acid sequence

SEQ ID NO: 7 - DNA, 44 bp, Artificial sequence
  Synthetic nucleic acid sequence
ctcaactggtgtcgtggagtcggcaattcagttgagaactgtac

SEQ ID NO: 8 - DNA, 44 bp, Artificial sequence
  Synthetic nucleic acid sequence
ctcaactggtgtcgtggagtcggcaattcagttgagaacagcac

SEQ ID NO: 9 - DNA, 44 bp, Artificial sequence
  Synthetic nucleic acid sequence
ctcaactggtgtcgtggagtcggcaattcagttgagatacatac

SEQ ID NO: 10 - DNA, 44 bp, Artificial sequence
  Synthetic nucleic acid sequence
ctcaactggtgtcgtggagtcggcaattcagttgagcacaagtt

SEQ ID NO: 11 - DNA, 44 bp, Artificial sequence
  Synthetic nucleic acid sequence
ctcaactggtgtcgtggagtcggcaattcagttgagttcagtta

SEQ ID NO: 12 - DNA, 44 bp, Artificial sequence
  Synthetic nucleic acid sequence
ctcaactggtgtcgtggagtcggcaattcagttgagtcatagcc

SEQ ID NO: 13 - DNA, 44 bp, Artificial sequence
  Synthetic nucleic acid sequence
ctcaactggtgtcgtggagtcggcaattcagttgagatctgcac

SEQ ID NO: 14 - DNA, 44 bp, Artificial sequence
  Synthetic nucleic acid sequence
ctcaactggtgtcgtggagtcggcaattcagttgagtgatagcc

SEQ ID NO: 15 - DNA, 44 bp, Artificial sequence
  Synthetic nucleic acid sequence
ctcaactggtgtcgtggagtcggcaattcagttgagcacaaatt

SEQ ID NO: 16 - DNA, 44 bp, Artificial sequence; identical to SEQ ID NO: 15
  Synthetic nucleic acid sequence

SEQ ID NO: 17 - DNA, 44 bp, Artificial sequence
  Synthetic nucleic acid sequence
ctcaactggtgtcgtggagtcggcaattcagttgagagaagtag

SEQ ID NO: 18 - DNA, 44 bp, Artificial sequence
  Synthetic nucleic acid sequence
ctcaactggtgtcgtggagtcggcaattcagttgagcaaacacc

SEQ ID NO: 19 - DNA, 44 bp, Artificial sequence
  Synthetic nucleic acid sequence
ctcaactggtgtcgtggagtcggcaattcagttgagggcattca

SEQ ID NO: 20 - DNA, 44 bp, Artificial sequence
  Synthetic nucleic acid sequence
ctcaactggtgtcgtggagtcggcaattcagttgagggctccca

SEQ ID NO: 21 - DNA, 44 bp, Artificial sequence
  Synthetic nucleic acid sequence
ctcaactggtgtcgtggagtcggcaattcagttgagtcacaggt

SEQ ID NO: 22 - DNA, 44 bp, Artificial sequence
  Synthetic nucleic acid sequence
ctcaactggtgtcgtggagtcggcaattcagttgagtcacaagt

SEQ ID NO: 23 - DNA, 44 bp, Artificial sequence
  Synthetic nucleic acid sequence
ctcaactggtgtcgtggagtcggcaattcagttgagcgcattat

SEQ ID NO: 24 - DNA, 44 bp, Artificial sequence
  Synthetic nucleic acid sequence
ctcaactggtgtcgtggagtcggcaattcagttgagagccaagc

SEQ ID NO: 25 - DNA, 44 bp, Artificial sequence
  Synthetic nucleic acid sequence
ctcaactggtgtcgtggagtcggcaattcagttgagaaagagac

SEQ ID NO: 26 - DNA, 44 bp, Artificial sequence
  Synthetic nucleic acid sequence
ctcaactggtgtcgtggagtcggcaattcagttgagatgctttt

SEQ ID NO: 27 - DNA, 44 bp, Artificial sequence
  Synthetic nucleic acid sequence
ctcaactggtgtcgtggagtcggcaattcagttgaggcaagccc

SEQ ID NO: 28 - DNA, 44 bp, Artificial sequence
  Synthetic nucleic acid sequence
ctcaactggtgtcgtggagtcggcaattcagttgagatgccctt

SEQ ID NO: 29 - DNA, 44 bp, Artificial sequence; identical to SEQ ID NO: 28
  Synthetic nucleic acid sequence

SEQ ID NO: 30 - DNA, 44 bp, Artificial sequence
  Synthetic nucleic acid sequence
ctcaactggtgtcgtggagtcggcaattcagttgagcgaccatg

SEQ ID NO: 31 - DNA, 44 bp, Artificial sequence
  Synthetic nucleic acid sequence
ctcaactggtgtcgtggagtcggcaattcagttgagcagctggt

SEQ ID NO: 32 - DNA, 44 bp, Artificial sequence
  Synthetic nucleic acid sequence
ctcaactggtgtcgtggagtcggcaattcagttgagtagctggt

SEQ ID NO: 33 - DNA, 44 bp, Artificial sequence
  Synthetic nucleic acid sequence
ctcaactggtgtcgtggagtcggcaattcagttgagcccctctg

SEQ ID NO: 34 - DNA, 44 bp, Artificial sequence
  Synthetic nucleic acid sequence
ctcaactggtgtcgtggagtcggcaattcagttgagtcacatag

SEQ ID NO: 35 - DNA, 44 bp, Artificial sequence; identical to SEQ ID NO: 34
  Synthetic nucleic acid sequence

SEQ ID NO: 36 - DNA, 44 bp, Artificial sequence
  Synthetic nucleic acid sequence
ctcaactggtgtcgtggagtcggcaattcagttgagctacgcgt

SEQ ID NO: 37 - DNA, 44 bp, Artificial sequence
  Synthetic nucleic acid sequence
ctcaactggtgtcgtggagtcggcaattcagttgagcggcctga

SEQ ID NO: 38 - DNA, 44 bp, Artificial sequence
  Synthetic nucleic acid sequence
ctcaactggtgtcgtggagtcggcaattcagttgagctggagac

SEQ ID NO: 39 - DNA, 44 bp, Artificial sequence
  Synthetic nucleic acid sequence
ctcaactggtgtcgtggagtcggcaattcagttgagctaccata

SEQ ID NO: 40 - DNA, 44 bp, Artificial sequence
  Synthetic nucleic acid sequence
ctcaactggtgtcgtggagtcggcaattcagttgagccatcttt

SEQ ID NO: 41 - DNA, 44 bp, Artificial sequence
  Synthetic nucleic acid sequence
ctcaactggtgtcgtggagtcggcaattcagttgagtccataaa

SEQ ID NO: 42 - DNA, 44 bp, Artificial sequence
  Synthetic nucleic acid sequence
ctcaactggtgtcgtggagtcggcaattcagttgagagtagtgc

SEQ ID NO: 43 - DNA, 44 bp, Artificial sequence
  Synthetic nucleic acid sequence
ctcaactggtgtcgtggagtcggcaattcagttgaggagctaca

SEQ ID NO: 44 - DNA, 44 bp, Artificial sequence
  Synthetic nucleic acid sequence
ctcaactggtgtcgtggagtcggcaattcagttgagagtacatc

SEQ ID NO: 45 - DNA, 44 bp, Artificial sequence
  Synthetic nucleic acid sequence
ctcaactggtgtcgtggagtcggcaattcagttgagagggattc

SEQ ID NO: 46 - DNA, 44 bp, Artificial sequence
  Synthetic nucleic acid sequence
ctcaactggtgtcgtggagtcggcaattcagttgagaacccatg

SEQ ID NO: 47 - DNA, 44 bp, Artificial sequence
  Synthetic nucleic acid sequence
ctcaactggtgtcgtggagtcggcaattcagttgagagcctatg

SEQ ID NO: 48 - DNA, 44 bp, Artificial sequence
  Synthetic nucleic acid sequence
ctcaactggtgtcgtggagtcggcaattcagttgagtagcagaa

SEQ ID NO: 49 - DNA, 44 bp, Artificial sequence
  Synthetic nucleic acid sequence
ctcaactggtgtcgtggagtcggcaattcagttgagacaaagtt

SEQ ID NO: 50 - DNA, 44 bp, Artificial sequence; identical to SEQ ID NO: 49
  Synthetic nucleic acid sequence

SEQ ID NO: 51 - DNA, 44 bp, Artificial sequence
  Synthetic nucleic acid sequence
ctcaactggtgtcgtggagtcggcaattcagttgaggggagtga

SEQ ID NO: 52 - DNA, 44 bp, Artificial sequence
  Synthetic nucleic acid sequence
ctcaactggtgtcgtggagtcggcaattcagttgagcactggta

SEQ ID NO: 53 - DNA, 44 bp, Artificial sequence
  Synthetic nucleic acid sequence
ctcaactggtgtcgtggagtcggcaattcagttgagactagact

SEQ ID NO: 54 - DNA, 44 bp, Artificial sequence
  Synthetic nucleic acid sequence
ctcaactggtgtcgtggagtcggcaattcagttgagccaagttc

SEQ ID NO: 55 - DNA, 44 bp, Artificial sequence
  Synthetic nucleic acid sequence
ctcaactggtgtcgtggagtcggcaattcagttgaggatcactt

SEQ ID NO: 56 - DNA, 44 bp, Artificial sequence
  Synthetic nucleic acid sequence
ctcaactggtgtcgtggagtcggcaattcagttgagcgaaggca

SEQ ID NO: 57 - DNA, 44 bp, Artificial sequence
  Synthetic nucleic acid sequence
ctcaactggtgtcgtggagtcggcaattcagttgagcacaaacc

SEQ ID NO: 58 - DNA, 44 bp, Artificial sequence
  Synthetic nucleic acid sequence
ctcaactggtgtcgtggagtcggcaattcagttgagtgtaaacc

SEQ ID NO: 59 - DNA, 44 bp, Artificial sequence
  Synthetic nucleic acid sequence
ctcaactggtgtcgtggagtcggcaattcagttgagcgccaata

SEQ ID NO: 60 - DNA, 44 bp, Artificial sequence
  Synthetic nucleic acid sequence
ctcaactggtgtcgtggagtcggcaattcagttgagctacctgc

SEQ ID NO: 61 - DNA, 44 bp, Artificial sequence
  Synthetic nucleic acid sequence
ctcaactggtgtcgtggagtcggcaattcagttgagactcaccg

SEQ ID NO: 62 - DNA, 44 bp, Artificial sequence
  Synthetic nucleic acid sequence
ctcaactggtgtcgtggagtcggcaattcagttgagacccaccg

SEQ ID NO: 63 - DNA, 44 bp, Artificial sequence; identical to SEQ ID NO: 61
  Synthetic nucleic acid sequence

SEQ ID NO: 64 - DNA, 44 bp, Artificial sequence; identical to SEQ ID NO: 62
  Synthetic nucleic acid sequence

SEQ ID NO: 65 - DNA, 44 bp, Artificial sequence
  Synthetic nucleic acid sequence
ctcaactggtgtcgtggagtcggcaattcagttgagagtgaatt

SEQ ID NO: 66 - DNA, 44 bp, Artificial sequence
  Synthetic nucleic acid sequence
ctcaactggtgtcgtggagtcggcaattcagttgagacccttat

SEQ ID NO: 67 - DNA, 44 bp, Artificial sequence
  Synthetic nucleic acid sequence
ctcaactggtgtcgtggagtcggcaattcagttgagtcaggaac

SEQ ID NO: 68 - DNA, 44 bp, Artificial sequence
  Synthetic nucleic acid sequence
ctcaactggtgtcgtggagtcggcaattcagttgagagcccaaa

SEQ ID NO: 69 - DNA, 44 bp, Artificial sequence
  Synthetic nucleic acid sequence
ctcaactggtgtcgtggagtcggcaattcagttgagccggctgc

SEQ ID NO: 70 - DNA, 44 bp, Artificial sequence
  Synthetic nucleic acid sequence
ctcaactggtgtcgtggagtcggcaattcagttgagtgcaaacc

SEQ ID NO: 71 - DNA, 44 bp, Artificial sequence
  Synthetic nucleic acid sequence
ctcaactggtgtcgtggagtcggcaattcagttgagccctccac

SEQ ID NO: 72 - DNA, 44 bp, Artificial sequence
  Synthetic nucleic acid sequence
ctcaactggtgtcgtggagtcggcaattcagttgagctatctgc

SEQ ID NO: 73 - DNA, 44 bp, Artificial sequence
  Synthetic nucleic acid sequence
ctcaactggtgtcgtggagtcggcaattcagttgagacctaata

SEQ ID NO: 74 - DNA, 44 bp, Artificial sequence
  Synthetic nucleic acid sequence
ctcaactggtgtcgtggagtcggcaattcagttgagaacccaat

SEQ ID NO: 75 - DNA, 44 bp, Artificial sequence
  Synthetic nucleic acid sequence
ctcaactggtgtcgtggagtcggcaattcagttgagcagctgct

SEQ ID NO: 76 - DNA, 44 bp, Artificial sequence
  Synthetic nucleic acid sequence
ctcaactggtgtcgtggagtcggcaattcagttgagggctgtca

SEQ ID NO: 77 - DNA, 44 bp, Artificial sequence
  Synthetic nucleic acid sequence
ctcaactggtgtcgtggagtcggcaattcagttgagactgggac

SEQ ID NO: 78 - DNA, 44 bp, Artificial sequence
  Synthetic nucleic acid sequence
ctcaactggtgtcgtggagtcggcaattcagttgagtccacatg

SEQ ID NO: 79 - DNA, 44 bp, Artificial sequence
  Synthetic nucleic acid sequence
ctcaactggtgtcgtggagtcggcaattcagttgaggccaatat

SEQ ID NO: 80 - DNA, 44 bp, Artificial sequence
  Synthetic nucleic acid sequence
ctcaactggtgtcgtggagtcggcaattcagttgagcccaacaa

SEQ ID NO: 81 - DNA, 44 bp, Artificial sequence; identical to SEQ ID NO: 80
  Synthetic nucleic acid sequence

SEQ ID NO: 82 - DNA, 44 bp, Artificial sequence
  Synthetic nucleic acid sequence
ctcaactggtgtcgtggagtcggcaattcagttgaggctgggtg

SEQ ID NO: 83 - DNA, 44 bp, Artificial sequence
  Synthetic nucleic acid sequence
ctcaactggtgtcgtggagtcggcaattcagttgaggaacaggt

SEQ ID NO: 84 - DNA, 44 bp, Artificial sequence
  Synthetic nucleic acid sequence
ctcaactggtgtcgtggagtcggcaattcagttgagtaaccaat

SEQ ID NO: 85 - DNA, 44 bp, Artificial sequence; identical to SEQ ID NO: 84
  Synthetic nucleic acid sequence

SEQ ID NO: 86 - DNA, 44 bp, Artificial sequence
  Synthetic nucleic acid sequence
ctcaactggtgtcgtggagtcggcaattcagttgagtcagtttt

SEQ ID NO: 87 - DNA, 44 bp, Artificial sequence; identical to SEQ ID NO: 86
  Synthetic nucleic acid sequence

SEQ ID NO: 88 - DNA, 44 bp, Artificial sequence
  Synthetic nucleic acid sequence
ctcaactggtgtcgtggagtcggcaattcagttgagacatcgtt

SEQ ID NO: 89 - DNA, 44 bp, Artificial sequence
  Synthetic nucleic acid sequence
ctcaactggtgtcgtggagtcggcaattcagttgagtcatcatt

SEQ ID NO: 90 - DNA, 44 bp, Artificial sequence
  Synthetic nucleic acid sequence
ctcaactggtgtcgtggagtcggcaattcagttgagtccatcat

SEQ ID NO: 91 - DNA, 44 bp, Artificial sequence
  Synthetic nucleic acid sequence
ctcaactggtgtcgtggagtcggcaattcagttgagctagtggt

SEQ ID NO: 92 - DNA, 44 bp, Artificial sequence
  Synthetic nucleic acid sequence
ctcaactggtgtcgtggagtcggcaattcagttgagaggcatag

SEQ ID NO: 93 - DNA, 44 bp, Artificial sequence
  Synthetic nucleic acid sequence
ctcaactggtgtcgtggagtcggcaattcagttgagcagactcc

SEQ ID NO: 94 - DNA, 44 bp, Artificial sequence
  Synthetic nucleic acid sequence
ctcaactggtgtcgtggagtcggcaattcagttgagccacacac

SEQ ID NO: 95 - DNA, 44 bp, Artificial sequence
  Synthetic nucleic acid sequence
ctcaactggtgtcgtggagtcggcaattcagttgagacaagctt

SEQ ID NO: 96 - DNA, 44 bp, Artificial sequence
  Synthetic nucleic acid sequence
ctcaactggtgtcgtggagtcggcaattcagttgagacaaacct

SEQ ID NO: 97 - DNA, 44 bp, Artificial sequence; identical to SEQ ID NO: 60
  Synthetic nucleic acid sequence

SEQ ID NO: 98 - DNA, 44 bp, Artificial sequence; identical to SEQ ID NO: 60
  Synthetic nucleic acid sequence

SEQ ID NO: 99 - DNA, 44 bp, Artificial sequence
  Synthetic nucleic acid sequence
ctcaactggtgtcgtggagtcggcaattcagttgagtcaacatc

SEQ ID NO: 100 - DNA, 44 bp, Artificial sequence
  Synthetic nucleic acid sequence
ctcaactggtgtcgtggagtcggcaattcagttgagtcagccgc

SEQ ID NO: 101 - DNA, 44 bp, Artificial sequence
  Synthetic nucleic acid sequence
ctcaactggtgtcgtggagtcggcaattcagttgagactgcctg

SEQ ID NO: 102 - DNA, 44 bp, Artificial sequence
  Synthetic nucleic acid sequence
ctcaactggtgtcgtggagtcggcaattcagttgagtcacagtt

SEQ ID NO: 103 - DNA, 44 bp, Artificial sequence
  Synthetic nucleic acid sequence
ctcaactggtgtcgtggagtcggcaattcagttgagtcacattt

SEQ ID NO: 104 - DNA, 44 bp, Artificial sequence
  Synthetic nucleic acid sequence
ctcaactggtgtcgtggagtcggcaattcagttgagacatggtt

SEQ ID NO: 105 - DNA, 44 bp, Artificial sequence
  Synthetic nucleic acid sequence
ctcaactggtgtcgtggagtcggcaattcagttgagagaattgc

SEQ ID NO: 106 - DNA, 44 bp, Artificial sequence
  Synthetic nucleic acid sequence
ctcaactggtgtcgtggagtcggcaattcagttgagacagttct

SEQ ID NO: 107 - DNA, 44 bp, Artificial sequence
  Synthetic nucleic acid sequence
ctcaactggtgtcgtggagtcggcaattcagttgaggaaaccca

SEQ ID NO: 108 - DNA, 44 bp, Artificial sequence
  Synthetic nucleic acid sequence
ctcaactggtgtcgtggagtcggcaattcagttgagacccagta

SEQ ID NO: 109 - DNA, 44 bp, Artificial sequence
  Synthetic nucleic acid sequence
ctcaactggtgtcgtggagtcggcaattcagttgagtggggtat

SEQ ID NO: 110 - DNA, 44 bp, Artificial sequence
  Synthetic nucleic acid sequence
ctcaactggtgtcgtggagtcggcaattcagttgagggaaatcc

SEQ ID NO: 111 - DNA, 44 bp, Artificial sequence
  Synthetic nucleic acid sequence
ctcaactggtgtcgtggagtcggcaattcagttgagggtaatcc

SEQ ID NO: 112 - DNA, 44 bp, Artificial sequence
  Synthetic nucleic acid sequence
ctcaactggtgtcgtggagtcggcaattcagttgagctgttcct

SEQ ID NO: 113 - DNA, 44 bp, Artificial sequence
  Synthetic nucleic acid sequence
ctcaactggtgtcgtggagtcggcaattcagttgagtcagaccg

SEQ ID NO: 114 - DNA, 44 bp, Artificial sequence
  Synthetic nucleic acid sequence
ctcaactggtgtcgtggagtcggcaattcagttgagagcctatc

SEQ ID NO: 115 - DNA, 44 bp, Artificial sequence
  Synthetic nucleic acid sequence
ctcaactggtgtcgtggagtcggcaattcagttgagacctatcc

SEQ ID NO: 116 - DNA, 44 bp, Artificial sequence
  Synthetic nucleic acid sequence
ctcaactggtgtcgtggagtcggcaattcagttgaggcggaact

SEQ ID NO: 117 - DNA, 44 bp, Artificial sequence
  Synthetic nucleic acid sequence
ctcaactggtgtcgtggagtcggcaattcagttgaggcagaact

SEQ ID NO: 118 - DNA, 44 bp, Artificial sequence
  Synthetic nucleic acid sequence
ctcaactggtgtcgtggagtcggcaattcagttgagctcaatag

SEQ ID NO: 119 - DNA, 44 bp, Artificial sequence
  Synthetic nucleic acid sequence
ctcaactggtgtcgtggagtcggcaattcagttgagggagagcc

SEQ ID NO: 120 - DNA, 44 bp, Artificial sequence
  Synthetic nucleic acid sequence
ctcaactggtgtcgtggagtcggcaattcagttgagacaggatt

SEQ ID NO: 121 - DNA, 44 bp, Artificial sequence
  Synthetic nucleic acid sequence
ctcaactggtgtcgtggagtcggcaattcagttgagtaaccgat

SEQ ID NO: 122 - DNA, 44 bp, Artificial sequence
  Synthetic nucleic acid sequence
ctcaactggtgtcgtggagtcggcaattcagttgagaacactga

SEQ ID NO: 123 - DNA, 44 bp, Artificial sequence; identical to SEQ ID NO: 121
  Synthetic nucleic acid sequence

SEQ ID NO: 124 - DNA, 44 bp, Artificial sequence
  Synthetic nucleic acid sequence
ctcaactggtgtcgtggagtcggcaattcagttgaggctttgac

SEQ ID NO: 125 - DNA, 44 bp, Artificial sequence
  Synthetic nucleic acid sequence
ctcaactggtgtcgtggagtcggcaattcagttgagtcaccaaa

SEQ ID NO: 126 - DNA, 44 bp, Artificial sequence
  Synthetic nucleic acid sequence
ctcaactggtgtcgtggagtcggcaattcagttgagctactaaa

SEQ ID NO: 127 - DNA, 44 bp, Artificial sequence
  Synthetic nucleic acid sequence
ctcaactggtgtcgtggagtcggcaattcagttgagacactcaa

SEQ ID NO: 128 - DNA, 44 bp, Artificial sequence
  Synthetic nucleic acid sequence
ctcaactggtgtcgtggagtcggcaattcagttgagcttccagt

SEQ ID NO: 129 - DNA, 44 bp, Artificial sequence
  Synthetic nucleic acid sequence
ctcaactggtgtcgtggagtcggcaattcagttgagagctgagt

SEQ ID NO: 130 - DNA, 44 bp, Artificial sequence
  Synthetic nucleic acid sequence
ctcaactggtgtcgtggagtcggcaattcagttgaggctgagag

SEQ ID NO: 131 - DNA, 44 bp, Artificial sequence; identical to SEQ ID NO: 128
  Synthetic nucleic acid sequence

SEQ ID NO: 132 - DNA, 44 bp, Artificial sequence; identical to SEQ ID NO: 128
  Synthetic nucleic acid sequence

SEQ ID NO: 133 - DNA, 44 bp, Artificial sequence
  Synthetic nucleic acid sequence
ctcaactggtgtcgtggagtcggcaattcagttgagtgcaactt

SEQ ID NO: 134 - DNA, 44 bp, Artificial sequence
  Synthetic nucleic acid sequence
ctcaactggtgtcgtggagtcggcaattcagttgagtcgccctc

SEQ ID NO: 135 - DNA, 44 bp, Artificial sequence
  Synthetic nucleic acid sequence
ctcaactggtgtcgtggagtcggcaattcagttgagagaggtcg

SEQ ID NO: 136 - DNA, 44 bp, Artificial sequence
  Synthetic nucleic acid sequence
ctcaactggtgtcgtggagtcggcaattcagttgaggcgaacgc

SEQ ID NO: 137 - DNA, 44 bp, Artificial sequence
  Synthetic nucleic acid sequence
ctcaactggtgtcgtggagtcggcaattcagttgagacaccaat

SEQ ID NO: 138 - DNA, 44 bp, Artificial sequence
  Synthetic nucleic acid sequence
ctcaactggtgtcgtggagtcggcaattcagttgagacggaagg

SEQ ID NO: 139 - DNA, 44 bp, Artificial sequence
  Synthetic nucleic acid sequence
ctcaactggtgtcgtggagtcggcaattcagttgagtgcaatgc

SEQ ID NO: 140 - DNA, 44 bp, Artificial sequence
  Synthetic nucleic acid sequence
ctcaactggtgtcgtggagtcggcaattcagttgaggcctaaga

SEQ ID NO: 141 - DNA, 44 bp, Artificial sequence
  Synthetic nucleic acid sequence
ctcaactggtgtcgtggagtcggcaattcagttgagttctagga

SEQ ID NO: 142 - DNA, 44 bp, Artificial sequence
  Synthetic nucleic acid sequence
ctcaactggtgtcgtggagtcggcaattcagttgagggatccct

SEQ ID NO: 143 - DNA, 44 bp, Artificial sequence
  Synthetic nucleic acid sequence
ctcaactggtgtcgtggagtcggcaattcagttgagacattttt

SEQ ID NO: 144 - DNA, 44 bp, Artificial sequence
  Synthetic nucleic acid sequence
ctcaactggtgtcgtggagtcggcaattcagttgagcaacaaaa

SEQ ID NO: 145 - DNA, 44 bp, Artificial sequence
  Synthetic nucleic acid sequence
ctcaactggtgtcgtggagtcggcaattcagttgagcactcagc

SEQ ID NO: 146 - DNA, 44 bp, Artificial sequence
  Synthetic nucleic acid sequence
ctcaactggtgtcgtggagtcggcaattcagttgagcgtgagct

SEQ ID NO: 147 - DNA, 44 bp, Artificial sequence
  Synthetic nucleic acid sequence
ctcaactggtgtcgtggagtcggcaattcagttgagaatcagtc

SEQ ID NO: 148 - DNA, 44 bp, Artificial sequence
  Synthetic nucleic acid sequence
ctcaactggtgtcgtggagtcggcaattcagttgagacgggtgc

SEQ ID NO: 149 - DNA, 44 bp, Artificial sequence
  Synthetic nucleic acid sequence
ctcaactggtgtcgtggagtcggcaattcagttgagacaaccag

SEQ ID NO: 150 - DNA, 44 bp, Artificial sequence
  Synthetic nucleic acid sequence
ctcaactggtgtcgtggagtcggcaattcagttgaggcaatcag

SEQ ID NO: 151 - DNA, 44 bp, Artificial sequence
  Synthetic nucleic acid sequence
ctcaactggtgtcgtggagtcggcaattcagttgaggtacccct

SEQ ID NO: 152 - DNA, 44 bp, Artificial sequence
  Synthetic nucleic acid sequence
ctcaactggtgtcgtggagtcggcaattcagttgagtacagatg

SEQ ID NO: 153 - DNA, 44 bp, Artificial sequence
  Synthetic nucleic acid sequence
ctcaactggtgtcgtggagtcggcaattcagttgagataaggat

SEQ ID NO: 154 - DNA, 44 bp, Artificial sequence
  Synthetic nucleic acid sequence
ctcaactggtgtcgtggagtcggcaattcagttgagtcaccatt

SEQ ID NO: 155 - DNA, 44 bp, Artificial sequence
  Synthetic nucleic acid sequence
ctcaactggtgtcgtggagtcggcaattcagttgagaaagatca

SEQ ID NO: 156 - DNA, 44 bp, Artificial sequence
  Synthetic nucleic acid sequence
ctcaactggtgtcgtggagtcggcaattcagttgaggcgaatat

SEQ ID NO: 157 - DNA, 44 bp, Artificial sequence
  Synthetic nucleic acid sequence
ctcaactggtgtcgtggagtcggcaattcagttgagaccaggtt

SEQ ID NO: 158 - DNA, 44 bp, Artificial sequence
  Synthetic nucleic acid sequence
ctcaactggtgtcgtggagtcggcaattcagttgagcacttagc

SEQ ID NO: 159 - DNA, 44 bp, Artificial sequence
  Synthetic nucleic acid sequence
ctcaactggtgtcgtggagtcggcaattcagttgagtcacgcga

SEQ ID NO: 160 - DNA, 44 bp, Artificial sequence
  Synthetic nucleic acid sequence
ctcaactggtgtcgtggagtcggcaattcagttgagacaaaagt

SEQ ID NO: 161 - DNA, 44 bp, Artificial sequence
  Synthetic nucleic acid sequence
ctcaactggtgtcgtggagtcggcaattcagttgagccttctga

SEQ ID NO: 162 - DNA, 44 bp, Artificial sequence
  Synthetic nucleic acid sequence
ctcaactggtgtcgtggagtcggcaattcagttgagcctacgtt

SEQ ID NO: 163 - DNA, 44 bp, Artificial sequence
  Synthetic nucleic acid sequence
ctcaactggtgtcgtggagtcggcaattcagttgagacagagag

SEQ ID NO: 164 - DNA, 44 bp, Artificial sequence
  Synthetic nucleic acid sequence
ctcaactggtgtcgtggagtcggcaattcagttgagcgaatcca

SEQ ID NO: 165 - DNA, 44 bp, Artificial sequence
  Synthetic nucleic acid sequence
ctcaactggtgtcgtggagtcggcaattcagttgagaggggttc

SEQ ID NO: 166 - DNA, 44 bp, Artificial sequence
  Synthetic nucleic acid sequence
ctcaactggtgtcgtggagtcggcaattcagttgagatgcaaag

SEQ ID NO: 167 - DNA, 44 bp, Artificial sequence
  Synthetic nucleic acid sequence
ctcaactggtgtcgtggagtcggcaattcagttgagacaggcca

SEQ ID NO: 168 - DNA, 44 bp, Artificial sequence
  Synthetic nucleic acid sequence
ctcaactggtgtcgtggagtcggcaattcagttgagcgtacgct

SEQ ID NO: 169 - DNA, 44 bp, Artificial sequence
  Synthetic nucleic acid sequence
ctcaactggtgtcgtggagtcggcaattcagttgaggcgcccaa

SEQ ID NO: 170 - DNA, 44 bp, Artificial sequence
  Synthetic nucleic acid sequence
ctcaactggtgtcgtggagtcggcaattcagttgagactgaggg

SEQ ID NO: 171 - DNA, 44 bp, Artificial sequence
  Synthetic nucleic acid sequence
ctcaactggtgtcgtggagtcggcaattcagttgagaaagtctc

SEQ ID NO: 172 - DNA, 44 bp, Artificial sequence
  Synthetic nucleic acid sequence
ctcaactggtgtcgtggagtcggcaattcagttgagtcaacggg

SEQ ID NO: 173 - DNA, 44 bp, Artificial sequence
  Synthetic nucleic acid sequence
ctcaactggtgtcgtggagtcggcaattcagttgagtgcatgac

SEQ ID NO: 174 - DNA, 44 bp, Artificial sequence
  Synthetic nucleic acid sequence
ctcaactggtgtcgtggagtcggcaattcagttgagacaccgag

SEQ ID NO: 175 - DNA, 44 bp, Artificial sequence
  Synthetic nucleic acid sequence
ctcaactggtgtcgtggagtcggcaattcagttgagatgggaca

SEQ ID NO: 176 - DNA, 44 bp, Artificial sequence
  Synthetic nucleic acid sequence
ctcaactggtgtcgtggagtcggcaattcagttgagaccagcta

SEQ ID NO: 177 - DNA, 44 bp, Artificial sequence
  Synthetic nucleic acid sequence
ctcaactggtgtcgtggagtcggcaattcagttgagatattagg

SEQ ID NO: 178 - DNA, 44 bp, Artificial sequence
  Synthetic nucleic acid sequence
ctcaactggtgtcgtggagtcggcaattcagttgagaactcagt

SEQ ID NO: 179 - DNA, 44 bp, Artificial sequence
  Synthetic nucleic acid sequence
ctcaactggtgtcgtggagtcggcaattcagttgagatcgggag

SEQ ID NO: 180 - DNA, 44 bp, Artificial sequence
  Synthetic nucleic acid sequence
ctcaactggtgtcgtggagtcggcaattcagttgaggaattcat

SEQ ID NO: 181 - DNA, 44 bp, Artificial sequence
  Synthetic nucleic acid sequence
ctcaactggtgtcgtggagtcggcaattcagttgagctcggggc

SEQ ID NO: 182 - DNA, 44 bp, Artificial sequence
  Synthetic nucleic acid sequence
ctcaactggtgtcgtggagtcggcaattcagttgagaagtggat

SEQ ID NO: 183 - DNA, 44 bp, Artificial sequence
  Synthetic nucleic acid sequence
ctcaactggtgtcgtggagtcggcaattcagttgagcagcatgg

SEQ ID NO: 184 - DNA, 44 bp, Artificial sequence
  Synthetic nucleic acid sequence
ctcaactggtgtcgtggagtcggcaattcagttgagcctcatgg

SEQ ID NO: 185 - DNA, 44 bp, Artificial sequence
  Synthetic nucleic acid sequence
ctcaactggtgtcgtggagtcggcaattcagttgaggaggtttc

SEQ ID NO: 186 - DNA, 44 bp, Artificial sequence
  Synthetic nucleic acid sequence
ctcaactggtgtcgtggagtcggcaattcagttgagaagaagtg

SEQ ID NO: 187 - DNA, 44 bp, Artificial sequence
  Synthetic nucleic acid sequence
ctcaactggtgtcgtggagtcggcaattcagttgaggagattgg

SEQ ID NO: 188 - DNA, 44 bp, Artificial sequence
  Synthetic nucleic acid sequence
ctcaactggtgtcgtggagtcggcaattcagttgagaaacatca

SEQ ID NO: 189 - DNA, 44 bp, Artificial sequence
  Synthetic nucleic acid sequence
ctcaactggtgtcgtggagtcggcaattcagttgaggatagagt

SEQ ID NO: 190 - DNA, 44 bp, Artificial sequence
  Synthetic nucleic acid sequence
ctcaactggtgtcgtggagtcggcaattcagttgagtgcaagcc

SEQ ID NO: 191 - DNA, 44 bp, Artificial sequence
  Synthetic nucleic acid sequence
ctcaactggtgtcgtggagtcggcaattcagttgagacggtcct

SEQ ID NO: 192 - DNA, 44 bp, Artificial sequence
  Synthetic nucleic acid sequence
ctcaactggtgtcgtggagtcggcaattcagttgagacacacca

SEQ ID NO: 193 - DNA, 44 bp, Artificial sequence
  Synthetic nucleic acid sequence
ctcaactggtgtcgtggagtcggcaattcagttgagtttcagtt

SEQ ID NO: 194 - DNA, 44 bp, Artificial sequence; identical to SEQ ID NO: 186
  Synthetic nucleic acid sequence

SEQ ID NO: 195 - DNA, 44 bp, Artificial sequence
  Synthetic nucleic acid sequence
ctcaactggtgtcgtggagtcggcaattcagttgagctgaaacc

SEQ ID NO: 196 - DNA, 44 bp, Artificial sequence
  Synthetic nucleic acid sequence
ctcaactggtgtcgtggagtcggcaattcagttgaggtgtgtat

SEQ ID NO: 197 - DNA, 44 bp, Artificial sequence
  Synthetic nucleic acid sequence
ctcaactggtgtcgtggagtcggcaattcagttgagtgtgggtg

SEQ ID NO: 198 - DNA, 44 bp, Artificial sequence
  Synthetic nucleic acid sequence
ctcaactggtgtcgtggagtcggcaattcagttgagacacactc

SEQ ID NO: 199 - DNA, 44 bp, Artificial sequence
  Synthetic nucleic acid sequence
ctcaactggtgtcgtggagtcggcaattcagttgagactagctt

SEQ ID NO: 200 - DNA, 44 bp, Artificial sequence
  Synthetic nucleic acid sequence
ctcaactggtgtcgtggagtcggcaattcagttgagctgcactt

SEQ ID NO: 201 - DNA, 44 bp, Artificial sequence
  Synthetic nucleic acid sequence
ctcaactggtgtcgtggagtcggcaattcagttgagaagaggga

SEQ ID NO: 202 - DNA, 44 bp, Artificial sequence
  Synthetic nucleic acid sequence
ctcaactggtgtcgtggagtcggcaattcagttgaggatccgag

SEQ ID NO: 203 - DNA, 44 bp, Artificial sequence
  Synthetic nucleic acid sequence
ctcaactggtgtcgtggagtcggcaattcagttgagcacaaccc

SEQ ID NO: 204 - DNA, 44 bp, Artificial sequence
  Synthetic nucleic acid sequence
ctcaactggtgtcgtggagtcggcaattcagttgagcagtagag

SEQ ID NO: 205 - DNA, 44 bp, Artificial sequence
  Synthetic nucleic acid sequence
ctcaactggtgtcgtggagtcggcaattcagttgagaaggtgat

SEQ ID NO: 206 - DNA, 44 bp, Artificial sequence
  Synthetic nucleic acid sequence
ctcaactggtgtcgtggagtcggcaattcagttgagggtggagc

SEQ ID NO: 207 - DNA, 44 bp, Artificial sequence
  Synthetic nucleic acid sequence
ctcaactggtgtcgtggagtcggcaattcagttgagctccagcc

SEQ ID NO: 208 - DNA, 44 bp, Artificial sequence
  Synthetic nucleic acid sequence
ctcaactggtgtcgtggagtcggcaattcagttgagcccagcta

SEQ ID NO: 209 - DNA, 44 bp, Artificial sequence
  Synthetic nucleic acid sequence
ctcaactggtgtcgtggagtcggcaattcagttgagtgctgtta

SEQ ID NO: 210 - DNA, 44 bp, Artificial sequence
  Synthetic nucleic acid sequence
ctcaactggtgtcgtggagtcggcaattcagttgagtccccaca

SEQ ID NO: 211 - DNA, 44 bp, Artificial sequence
  Synthetic nucleic acid sequence
ctcaactggtgtcgtggagtcggcaattcagttgagacaacaaa

SEQ ID NO: 212 - DNA, 44 bp, Artificial sequence
  Synthetic nucleic acid sequence
ctcaactggtgtcgtggagtcggcaattcagttgagaggagact

SEQ ID NO: 213 - DNA, 44 bp, Artificial sequence
  Synthetic nucleic acid sequence
ctcaactggtgtcgtggagtcggcaattcagttgagtcggtccc

SEQ ID NO: 214 - DNA, 44 bp, Artificial sequence
  Synthetic nucleic acid sequence
ctcaactggtgtcgtggagtcggcaattcagttgagcacctgat

SEQ ID NO: 215 - DNA, 44 bp, Artificial sequence
  Synthetic nucleic acid sequence
ctcaactggtgtcgtggagtcggcaattcagttgagccctgcgc

SEQ ID NO: 216 - DNA, 44 bp, Artificial sequence
  Synthetic nucleic acid sequence
ctcaactggtgtcgtggagtcggcaattcagttgagtcatacag

SEQ ID NO: 217 - DNA, 44 bp, Artificial sequence
  Synthetic nucleic acid sequence
ctcaactggtgtcgtggagtcggcaattcagttgagggaggccg

SEQ ID NO: 218 - DNA, 44 bp, Artificial sequence; identical to SEQ ID NO: 60
  Synthetic nucleic acid sequence

SEQ ID NO: 219 - DNA, 44 bp, Artificial sequence
  Synthetic nucleic acid sequence
ctcaactggtgtcgtggagtcggcaattcagttgagagcaaaaa

SEQ ID NO: 220 - DNA, 44 bp, Artificial sequence
  Synthetic nucleic acid sequence
ctcaactggtgtcgtggagtcggcaattcagttgagaacaatac

SEQ ID NO: 221 - DNA, 44 bp, Artificial sequence
  Synthetic nucleic acid sequence
ctcaactggtgtcgtggagtcggcaattcagttgagcacaagat

SEQ ID NO: 222 - DNA, 44 bp, Artificial sequence
  Synthetic nucleic acid sequence
ctcaactggtgtcgtggagtcggcaattcagttgagcgcaaggt

SEQ ID NO: 223 - DNA, 44 bp, Artificial sequence
  Synthetic nucleic acid sequence
ctcaactggtgtcgtggagtcggcaattcagttgagaccacagg

SEQ ID NO: 224 - DNA, 44 bp, Artificial sequence; identical to SEQ ID NO: 60
  Synthetic nucleic acid sequence

SEQ ID NO: 225 - DNA, 44 bp, Artificial sequence
  Synthetic nucleic acid sequence
ctcaactggtgtcgtggagtcggcaattcagttgagctagggaa

SEQ ID NO: 226 - DNA, 44 bp, Artificial sequence
  Synthetic nucleic acid sequence
ctcaactggtgtcgtggagtcggcaattcagttgagccaaccaa

SEQ ID NO: 227 - DNA, 44 bp, Artificial sequence
  Synthetic nucleic acid sequence
ctcaactggtgtcgtggagtcggcaattcagttgagacacaccc

SEQ ID NO: 228 - DNA, 44 bp, Artificial sequence
  Synthetic nucleic acid sequence
ctcaactggtgtcgtggagtcggcaattcagttgagcggctcgg

SEQ ID NO: 229 - DNA, 44 bp, Artificial sequence
  Synthetic nucleic acid sequence
ctcaactggtgtcgtggagtcggcaattcagttgaggtcacatc

SEQ ID NO: 230 - DNA, 44 bp, Artificial sequence
  Synthetic nucleic acid sequence
ctcaactggtgtcgtggagtcggcaattcagttgagtgcccact

SEQ ID NO: 231 - DNA, 44 bp, Artificial sequence
  Synthetic nucleic acid sequence
ctcaactggtgtcgtggagtcggcaattcagttgagggaagcca

SEQ ID NO: 232 - DNA, 44 bp, Artificial sequence
  Synthetic nucleic acid sequence
ctcaactggtgtcgtggagtcggcaattcagttgagaacataca

SEQ ID NO: 233 - DNA, 44 bp, Artificial sequence
  Synthetic nucleic acid sequence
ctcaactggtgtcgtggagtcggcaattcagttgaggaggctca

SEQ ID NO: 234 - DNA, 44 bp, Artificial sequence
  Synthetic nucleic acid sequence
ctcaactggtgtcgtggagtcggcaattcagttgagtcagagca

SEQ ID NO: 235 - DNA, 44 bp, Artificial sequence
  Synthetic nucleic acid sequence
ctcaactggtgtcgtggagtcggcaattcagttgagctccccca

SEQ ID NO: 236 - DNA, 44 bp, Artificial sequence
  Synthetic nucleic acid sequence
ctcaactggtgtcgtggagtcggcaattcagttgaggagctgca

SEQ ID NO: 237 - DNA, 44 bp, Artificial sequence
  Synthetic nucleic acid sequence
ctcaactggtgtcgtggagtcggcaattcagttgagataatgga

SEQ ID NO: 238 - DNA, 44 bp, Artificial sequence
  Synthetic nucleic acid sequence
ctcaactggtgtcgtggagtcggcaattcagttgagctcaaagc

SEQ ID NO: 239 - DNA, 44 bp, Artificial sequence
  Synthetic nucleic acid sequence
ctcaactggtgtcgtggagtcggcaattcagttgaggcttaaac

SEQ ID NO: 240 - DNA, 44 bp, Artificial sequence
  Synthetic nucleic acid sequence
ctcaactggtgtcgtggagtcggcaattcagttgaggaaatgag

SEQ ID NO: 241 - DNA, 44 bp, Artificial sequence
  Synthetic nucleic acid sequence
ctcaactggtgtcgtggagtcggcaattcagttgagcccctccc

SEQ ID NO: 242 - DNA, 44 bp, Artificial sequence
  Synthetic nucleic acid sequence
ctcaactggtgtcgtggagtcggcaattcagttgagtccgcctg

SEQ ID NO: 243 - DNA, 44 bp, Artificial sequence
  Synthetic nucleic acid sequence
ctcaactggtgtcgtggagtcggcaattcagttgagctgaggag

SEQ ID NO: 244 - DNA, 44 bp, Artificial sequence
  Synthetic nucleic acid sequence
ctcaactggtgtcgtggagtcggcaattcagttgagccacctcc

SEQ ID NO: 245 - DNA, 44 bp, Artificial sequence
  Synthetic nucleic acid sequence
ctcaactggtgtcgtggagtcggcaattcagttgagctgggggc

SEQ ID NO: 246 - DNA, 44 bp, Artificial sequence
  Synthetic nucleic acid sequence
ctcaactggtgtcgtggagtcggcaattcagttgagccccccac

SEQ ID NO: 247 - DNA, 44 bp, Artificial sequence; identical to SEQ ID NO: 225
  Synthetic nucleic acid sequence

SEQ ID NO: 248 - DNA, 44 bp, Artificial sequence
  Synthetic nucleic acid sequence
ctcaactggtgtcgtggagtcggcaattcagttgagctggggaa

SEQ ID NO: 249 - DNA, 44 bp, Artificial sequence
  Synthetic nucleic acid sequence
ctcaactggtgtcgtggagtcggcaattcagttgagggggggcg

SEQ ID NO: 250 - DNA, 44 bp, Artificial sequence
  Synthetic nucleic acid sequence
ctcaactggtgtcgtggagtcggcaattcagttgagctgtggga

SEQ ID NO: 251 - DNA, 44 bp, Artificial sequence
  Synthetic nucleic acid sequence
ctcaactggtgtcgtggagtcggcaattcagttgaggcagctgt

SEQ ID NO: 252 - DNA, 44 bp, Artificial sequence
  Synthetic nucleic acid sequence
ctcaactggtgtcgtggagtcggcaattcagttgagctgcggga

SEQ ID NO: 253 - DNA, 44 bp, Artificial sequence
  Synthetic nucleic acid sequence
ctcaactggtgtcgtggagtcggcaattcagttgaggtggggtg

SEQ ID NO: 254 - DNA, 44 bp, Artificial sequence
  Synthetic nucleic acid sequence
ctcaactggtgtcgtggagtcggcaattcagttgagctggagag

SEQ ID NO: 255 - DNA, 44 bp, Artificial sequence
  Synthetic nucleic acid sequence
ctcaactggtgtcgtggagtcggcaattcagttgagctggggga

SEQ ID NO: 256 - DNA, 44 bp, Artificial sequence
  Synthetic nucleic acid sequence
ctcaactggtgtcgtggagtcggcaattcagttgagggggcaga

SEQ ID NO: 257 - DNA, 44 bp, Artificial sequence
  Synthetic nucleic acid sequence
ctcaactggtgtcgtggagtcggcaattcagttgagcactccta

SEQ ID NO: 258 - DNA, 44 bp, Artificial sequence
  Synthetic nucleic acid sequence
ctcaactggtgtcgtggagtcggcaattcagttgagaaccatct

SEQ ID NO: 259 - DNA, 44 bp, Artificial sequence
  Synthetic nucleic acid sequence
ctcaactggtgtcgtggagtcggcaattcagttgagatgtaggc

SEQ ID NO: 260 - DNA, 44 bp, Artificial sequence
  Synthetic nucleic acid sequence
ctcaactggtgtcgtggagtcggcaattcagttgagcctgctcc

SEQ ID NO: 261 - DNA, 44 bp, Artificial sequence
  Synthetic nucleic acid sequence
ctcaactggtgtcgtggagtcggcaattcagttgagtccgggga

SEQ ID NO: 262 - DNA, 44 bp, Artificial sequence
  Synthetic nucleic acid sequence
ctcaactggtgtcgtggagtcggcaattcagttgagtttagcac

SEQ ID NO: 263 - DNA, 44 bp, Artificial sequence
  Synthetic nucleic acid sequence
ctcaactggtgtcgtggagtcggcaattcagttgagtgaagaag

SEQ ID NO: 264 - DNA, 44 bp, Artificial sequence
  Synthetic nucleic acid sequence
ctcaactggtgtcgtggagtcggcaattcagttgagaaaggcca

SEQ ID NO: 265 - DNA, 44 bp, Artificial sequence
  Synthetic nucleic acid sequence
ctcaactggtgtcgtggagtcggcaattcagttgagagcgcctt

SEQ ID NO: 266 - DNA, 44 bp, Artificial sequence
  Synthetic nucleic acid sequence
ctcaactggtgtcgtggagtcggcaattcagttgagtaaatgaa

SEQ ID NO: 267 - DNA, 44 bp, Artificial sequence
  Synthetic nucleic acid sequence
ctcaactggtgtcgtggagtcggcaattcagttgagtgcaggct

SEQ ID NO: 268 - DNA, 44 bp, Artificial sequence
  Synthetic nucleic acid sequence
ctcaactggtgtcgtggagtcggcaattcagttgagactgcagg

SEQ ID NO: 269 - DNA, 44 bp, Artificial sequence
  Synthetic nucleic acid sequence
ctcaactggtgtcgtggagtcggcaattcagttgagaatctact

SEQ ID NO: 270 - DNA, 44 bp, Artificial sequence
  Synthetic nucleic acid sequence
ctcaactggtgtcgtggagtcggcaattcagttgagaaccactt

SEQ ID NO: 271 - DNA, 44 bp, Artificial sequence
  Synthetic nucleic acid sequence
ctcaactggtgtcgtggagtcggcaattcagttgagagctagtg

SEQ ID NO: 272 - DNA, 44 bp, Artificial sequence
  Synthetic nucleic acid sequence
ctcaactggtgtcgtggagtcggcaattcagttgagggtcagaa

SEQ ID NO: 273 - DNA, 44 bp, Artificial sequence
  Synthetic nucleic acid sequence
ctcaactggtgtcgtggagtcggcaattcagttgagttccacga

SEQ ID NO: 274 - DNA, 44 bp, Artificial sequence
  Synthetic nucleic acid sequence
ctcaactggtgtcgtggagtcggcaattcagttgagaaaagcta

SEQ ID NO: 275 - DNA, 44 bp, Artificial sequence
  Synthetic nucleic acid sequence
ctcaactggtgtcgtggagtcggcaattcagttgagtggtggca

SEQ ID NO: 276 - DNA, 44 bp, Artificial sequence
  Synthetic nucleic acid sequence
ctcaactggtgtcgtggagtcggcaattcagttgagaagccaaa

SEQ ID NO: 277 - DNA, 44 bp, Artificial sequence
  Synthetic nucleic acid sequence
ctcaactggtgtcgtggagtcggcaattcagttgagatccttct

SEQ ID NO: 278 - DNA, 44 bp, Artificial sequence
  Synthetic nucleic acid sequence
ctcaactggtgtcgtggagtcggcaattcagttgagactcagta

SEQ ID NO: 279 - DNA, 44 bp, Artificial sequence
  Synthetic nucleic acid sequence
ctcaactggtgtcgtggagtcggcaattcagttgagaacaggtg

SEQ ID NO: 280 - DNA, 44 bp, Artificial sequence
  Synthetic nucleic acid sequence
ctcaactggtgtcgtggagtcggcaattcagttgagaacaacac

SEQ ID NO: 281 - DNA, 44 bp, Artificial sequence
  Synthetic nucleic acid sequence
ctcaactggtgtcgtggagtcggcaattcagttgagagccctgt

SEQ ID NO: 282 - DNA, 44 bp, Artificial sequence
  Synthetic nucleic acid sequence
ctcaactggtgtcgtggagtcggcaattcagttgagtggggatt

SEQ ID NO: 283 - DNA, 44 bp, Artificial sequence
  Synthetic nucleic acid sequence
ctcaactggtgtcgtggagtcggcaattcagttgagcccccacc

SEQ ID NO: 284 - DNA, 44 bp, Artificial sequence
  Synthetic nucleic acid sequence
ctcaactggtgtcgtggagtcggcaattcagttgagccagtagc

SEQ ID NO: 285 - DNA, 44 bp, Artificial sequence
  Synthetic nucleic acid sequence
ctcaactggtgtcgtggagtcggcaattcagttgagacacagct

SEQ ID NO: 286 - DNA, 44 bp, Artificial sequence
  Synthetic nucleic acid sequence
ctcaactggtgtcgtggagtcggcaattcagttgagtgagtgct

SEQ ID NO: 287 - DNA, 44 bp, Artificial sequence
  Synthetic nucleic acid sequence
ctcaactggtgtcgtggagtcggcaattcagttgagtttcagaa

SEQ ID NO: 288 - DNA, 44 bp, Artificial sequence
  Synthetic nucleic acid sequence
ctcaactggtgtcgtggagtcggcaattcagttgagaagaaaga

SEQ ID NO: 289 - DNA, 44 bp, Artificial sequence
  Synthetic nucleic acid sequence
ctcaactggtgtcgtggagtcggcaattcagttgagtggcgcct

SEQ ID NO: 290 - DNA, 44 bp, Artificial sequence
  Synthetic nucleic acid sequence
ctcaactggtgtcgtggagtcggcaattcagttgagtggcgccc

SEQ ID NO: 291 - DNA, 44 bp, Artificial sequence
  Synthetic nucleic acid sequence
ctcaactggtgtcgtggagtcggcaattcagttgaggacagcct

SEQ ID NO: 292 - DNA, 44 bp, Artificial sequence
  Synthetic nucleic acid sequence
ctcaactggtgtcgtggagtcggcaattcagttgagatcagagc

SEQ ID NO: 293 - DNA, 44 bp, Artificial sequence
  Synthetic nucleic acid sequence
ctcaactggtgtcgtggagtcggcaattcagttgagtgtctcca

SEQ ID NO: 294 - DNA, 44 bp, Artificial sequence
  Synthetic nucleic acid sequence
ctcaactggtgtcgtggagtcggcaattcagttgagaaaataca

SEQ ID NO: 295 - DNA, 44 bp, Artificial sequence
  Synthetic nucleic acid sequence
ctcaactggtgtcgtggagtcggcaattcagttgagatagatga

SEQ ID NO: 296 - DNA, 44 bp, Artificial sequence
  Synthetic nucleic acid sequence
ctcaactggtgtcgtggagtcggcaattcagttgagagaaagaa

SEQ ID NO: 297 - DNA, 44 bp, Artificial sequence
  Synthetic nucleic acid sequence
ctcaactggtgtcgtggagtcggcaattcagttgaggggtggca

SEQ ID NO: 298 - DNA, 44 bp, Artificial sequence
  Synthetic nucleic acid sequence
ctcaactggtgtcgtggagtcggcaattcagttgaggggagagg

SEQ ID NO: 299 - DNA, 44 bp, Artificial sequence
  Synthetic nucleic acid sequence
ctcaactggtgtcgtggagtcggcaattcagttgagaagcagaa

SEQ ID NO: 300 - DNA, 44 bp, Artificial sequence
  Synthetic nucleic acid sequence
ctcaactggtgtcgtggagtcggcaattcagttgagagaaagcg

SEQ ID NO: 301 - DNA, 44 bp, Artificial sequence
  Synthetic nucleic acid sequence
ctcaactggtgtcgtggagtcggcaattcagttgaggaaaagcc

SEQ ID NO: 302 - DNA, 44 bp, Artificial sequence
  Synthetic nucleic acid sequence
ctcaactggtgtcgtggagtcggcaattcagttgagaggtctca

SEQ ID NO: 303 - DNA, 44 bp, Artificial sequence
  Synthetic nucleic acid sequence
ctcaactggtgtcgtggagtcggcaattcagttgagagggctca

SEQ ID NO: 304 - DNA, 44 bp, Artificial sequence
  Synthetic nucleic acid sequence
ctcaactggtgtcgtggagtcggcaattcagttgaggactcgaa

SEQ ID NO: 305 - DNA, 44 bp, Artificial sequence
  Synthetic nucleic acid sequence
ctcaactggtgtcgtggagtcggcaattcagttgagtctccaga

SEQ ID NO: 306 - DNA, 44 bp, Artificial sequence
  Synthetic nucleic acid sequence
ctcaactggtgtcgtggagtcggcaattcagttgagaaaatgca

SEQ ID NO: 307 - DNA, 44 bp, Artificial sequence
  Synthetic nucleic acid sequence
ctcaactggtgtcgtggagtcggcaattcagttgagtccctgat

SEQ ID NO: 308 - DNA, 44 bp, Artificial sequence
  Synthetic nucleic acid sequence
ctcaactggtgtcgtggagtcggcaattcagttgagactgctgg

SEQ ID NO: 309 - DNA, 44 bp, Artificial sequence
  Synthetic nucleic acid sequence
ctcaactggtgtcgtggagtcggcaattcagttgagcagcgtct

SEQ ID NO: 310 - DNA, 44 bp, Artificial sequence
  Synthetic nucleic acid sequence
ctcaactggtgtcgtggagtcggcaattcagttgaggcacaaat

SEQ ID NO: 311 - DNA, 44 bp, Artificial sequence
  Synthetic nucleic acid sequence
ctcaactggtgtcgtggagtcggcaattcagttgagagacaaca

SEQ ID NO: 312 - DNA, 44 bp, Artificial sequence
  Synthetic nucleic acid sequence
ctcaactggtgtcgtggagtcggcaattcagttgagtcacccag

SEQ ID NO: 313 - DNA, 44 bp, Artificial sequence
  Synthetic nucleic acid sequence
ctcaactggtgtcgtggagtcggcaattcagttgagggagatgg

SEQ ID NO: 314 - DNA, 44 bp, Artificial sequence
  Synthetic nucleic acid sequence
ctcaactggtgtcgtggagtcggcaattcagttgagcacctgaa

SEQ ID NO: 315 - DNA, 44 bp, Artificial sequence
  Synthetic nucleic acid sequence
ctcaactggtgtcgtggagtcggcaattcagttgagtacatctg

SEQ ID NO: 316 - DNA, 44 bp, Artificial sequence
  Synthetic nucleic acid sequence
ctcaactggtgtcgtggagtcggcaattcagttgagtccctcac

SEQ ID NO: 317 - DNA, 44 bp, Artificial sequence
  Synthetic nucleic acid sequence
ctcaactggtgtcgtggagtcggcaattcagttgagcagcagcc

SEQ ID NO: 318 - DNA, 44 bp, Artificial sequence
  Synthetic nucleic acid sequence
ctcaactggtgtcgtggagtcggcaattcagttgaggaagtcac

SEQ ID NO: 319 - DNA, 44 bp, Artificial sequence
  Synthetic nucleic acid sequence
ctcaactggtgtcgtggagtcggcaattcagttgagtttagcat

SEQ ID NO: 320 - DNA, 44 bp, Artificial sequence
  Synthetic nucleic acid sequence
ctcaactggtgtcgtggagtcggcaattcagttgagagagcaag

SEQ ID NO: 321 - DNA, 44 bp, Artificial sequence
  Synthetic nucleic acid sequence
ctcaactggtgtcgtggagtcggcaattcagttgagcacatctc

SEQ ID NO: 322 - DNA, 44 bp, Artificial sequence
  Synthetic nucleic acid sequence
ctcaactggtgtcgtggagtcggcaattcagttgagtctctccc

SEQ ID NO: 323 - DNA, 44 bp, Artificial sequence
  Synthetic nucleic acid sequence
ctcaactggtgtcgtggagtcggcaattcagttgagcaccacca

SEQ ID NO: 324 - DNA, 44 bp, Artificial sequence
  Synthetic nucleic acid sequence
ctcaactggtgtcgtggagtcggcaattcagttgagcacgaccg

SEQ ID NO: 325 - DNA, 44 bp, Artificial sequence
  Synthetic nucleic acid sequence
ctcaactggtgtcgtggagtcggcaattcagttgagccactgaa

SEQ ID NO: 326 - DNA, 44 bp, Artificial sequence
  Synthetic nucleic acid sequence
ctcaactggtgtcgtggagtcggcaattcagttgagatcacatt

SEQ ID NO: 327 - DNA, 44 bp, Artificial sequence
  Synthetic nucleic acid sequence
ctcaactggtgtcgtggagtcggcaattcagttgagcagcatca

SEQ ID NO: 328 - DNA, 44 bp, Artificial sequence
  Synthetic nucleic acid sequence
ctcaactggtgtcgtggagtcggcaattcagttgagagaaaatg

SEQ ID NO: 329 - DNA, 44 bp, Artificial sequence
  Synthetic nucleic acid sequence
ctcaactggtgtcgtggagtcggcaattcagttgaggaaagtgc

SEQ ID NO: 330 - DNA, 44 bp, Artificial sequence; identical to SEQ ID NO: 90
  Synthetic nucleic acid sequence

SEQ ID NO: 331 - DNA, 44 bp, Artificial sequence
  Synthetic nucleic acid sequence
ctcaactggtgtcgtggagtcggcaattcagttgagactccaac

SEQ ID NO: 332 - DNA, 44 bp, Artificial sequence
  Synthetic nucleic acid sequence
ctcaactggtgtcgtggagtcggcaattcagttgagccgtggtt

SEQ ID NO: 333 - DNA, 44 bp, Artificial sequence
  Synthetic nucleic acid sequence
ctcaactggtgtcgtggagtcggcaattcagttgagccagaact

SEQ ID NO: 334 - DNA, 44 bp, Artificial sequence
  Synthetic nucleic acid sequence
ctcaactggtgtcgtggagtcggcaattcagttgaggcagaagc

SEQ ID NO: 335 - DNA, 44 bp, Artificial sequence
  Synthetic nucleic acid sequence
ctcaactggtgtcgtggagtcggcaattcagttgagcctcaagg

SEQ ID NO: 336 - DNA, 44 bp, Artificial sequence
  Synthetic nucleic acid sequence
ctcaactggtgtcgtggagtcggcaattcagttgagacccctat

SEQ ID NO: 337 - DNA, 44 bp, Artificial sequence
  Synthetic nucleic acid sequence
ctcaactggtgtcgtggagtcggcaattcagttgagagtgtgag

SEQ ID NO: 338 - DNA, 44 bp, Artificial sequence
  Synthetic nucleic acid sequence
ctcaactggtgtcgtggagtcggcaattcagttgagggagagga

SEQ ID NO: 339 - DNA, 44 bp, Artificial sequence
  Synthetic nucleic acid sequence
ctcaactggtgtcgtggagtcggcaattcagttgagattgcgtt

SEQ ID NO: 340 - DNA, 44 bp, Artificial sequence
  Synthetic nucleic acid sequence
ctcaactggtgtcgtggagtcggcaattcagttgagattcaatc

SEQ ID NO: 341 - DNA, 44 bp, Artificial sequence
  Synthetic nucleic acid sequence
ctcaactggtgtcgtggagtcggcaattcagttgagctaactgc

SEQ ID NO: 342 - DNA, 44 bp, Artificial sequence
  Synthetic nucleic acid sequence
ctcaactggtgtcgtggagtcggcaattcagttgagtcatctcg

SEQ ID NO: 343 - DNA, 44 bp, Artificial sequence
  Synthetic nucleic acid sequence
ctcaactggtgtcgtggagtcggcaattcagttgagagcgggac

SEQ ID NO: 344 - DNA, 44 bp, Artificial sequence
  Synthetic nucleic acid sequence
ctcaactggtgtcgtggagtcggcaattcagttgaggaacctat

SEQ ID NO: 345 - DNA, 44 bp, Artificial sequence
  Synthetic nucleic acid sequence
ctcaactggtgtcgtggagtcggcaattcagttgaggaacagat

SEQ ID NO: 346 - DNA, 44 bp, Artificial sequence
  Synthetic nucleic acid sequence
ctcaactggtgtcgtggagtcggcaattcagttgagttcccatg

SEQ ID NO: 347 - DNA, 44 bp, Artificial sequence
  Synthetic nucleic acid sequence
ctcaactggtgtcgtggagtcggcaattcagttgagaggcgaag

SEQ ID NO: 348 - DNA, 44 bp, Artificial sequence
  Synthetic nucleic acid sequence
ctcaactggtgtcgtggagtcggcaattcagttgagggccgtga

SEQ ID NO: 349 - DNA, 44 bp, Artificial sequence
  Synthetic nucleic acid sequence
ctcaactggtgtcgtggagtcggcaattcagttgaggtctgtca

SEQ ID NO: 350 - DNA, 44 bp, Artificial sequence
  Synthetic nucleic acid sequence
ctcaactggtgtcgtggagtcggcaattcagttgagtccaatca

SEQ ID NO: 351 - DNA, 44 bp, Artificial sequence
  Synthetic nucleic acid sequence
ctcaactggtgtcgtggagtcggcaattcagttgagcgggacgt

SEQ ID NO: 352 - DNA, 44 bp, Artificial sequence
  Synthetic nucleic acid sequence
ctcaactggtgtcgtggagtcggcaattcagttgagacagatgt

SEQ ID NO: 353 - DNA, 44 bp, Artificial sequence
  Synthetic nucleic acid sequence
ctcaactggtgtcgtggagtcggcaattcagttgagaaagtgtc

SEQ ID NO: 354 - DNA, 44 bp, Artificial sequence
  Synthetic nucleic acid sequence
ctcaactggtgtcgtggagtcggcaattcagttgagaagtgtca

SEQ ID NO: 355 - DNA, 44 bp, Artificial sequence
  Synthetic nucleic acid sequence
ctcaactggtgtcgtggagtcggcaattcagttgagagtcttca

SEQ ID NO: 356 - DNA, 44 bp, Artificial sequence
  Synthetic nucleic acid sequence
ctcaactggtgtcgtggagtcggcaattcagttgagaacggaac

SEQ ID NO: 357 - DNA, 44 bp, Artificial sequence
  Synthetic nucleic acid sequence
ctcaactggtgtcgtggagtcggcaattcagttgagtccaggag

SEQ ID NO: 358 - DNA, 44 bp, Artificial sequence
  Synthetic nucleic acid sequence
ctcaactggtgtcgtggagtcggcaattcagttgagcatgcaca

SEQ ID NO: 359 - DNA, 44 bp, Artificial sequence
  Synthetic nucleic acid sequence
ctcaactggtgtcgtggagtcggcaattcagttgagtgggagaa

SEQ ID NO: 360 - DNA, 44 bp, Artificial sequence
  Synthetic nucleic acid sequence
ctcaactggtgtcgtggagtcggcaattcagttgagaagcggtt

SEQ ID NO: 361 - DNA, 44 bp, Artificial sequence
  Synthetic nucleic acid sequence
ctcaactggtgtcgtggagtcggcaattcagttgagatgtatgt

SEQ ID NO: 362 - DNA, 44 bp, Artificial sequence
  Synthetic nucleic acid sequence
ctcaactggtgtcgtggagtcggcaattcagttgagagagagag

SEQ ID NO: 363 - DNA, 44 bp, Artificial sequence; identical to SEQ ID NO: 124
  Synthetic nucleic acid sequence

SEQ ID NO: 364 - DNA, 44 bp, Artificial sequence; identical to SEQ ID NO: 325
  Synthetic nucleic acid sequence

SEQ ID NO: 365 - DNA, 44 bp, Artificial sequence
  Synthetic nucleic acid sequence
ctcaactggtgtcgtggagtcggcaattcagttgagaagcatgg

SEQ ID NO: 366 - DNA, 44 bp, Artificial sequence
  Synthetic nucleic acid sequence
ctcaactggtgtcgtggagtcggcaattcagttgagaaacatgg

SEQ ID NO: 367 - DNA, 44 bp, Artificial sequence
  Synthetic nucleic acid sequence
ctcaactggtgtcgtggagtcggcaattcagttgagagctatgc

SEQ ID NO: 368 - DNA, 44 bp, Artificial sequence
  Synthetic nucleic acid sequence
ctcaactggtgtcgtggagtcggcaattcagttgagttgccctc

SEQ ID NO: 369 - DNA, 44 bp, Artificial sequence
  Synthetic nucleic acid sequence
ctcaactggtgtcgtggagtcggcaattcagttgagaccctctc

SEQ ID NO: 370 - DNA, 44 bp, Artificial sequence
  Synthetic nucleic acid sequence
ctcaactggtgtcgtggagtcggcaattcagttgagtcctctca

SEQ ID NO: 371 - DNA, 44 bp, Artificial sequence
  Synthetic nucleic acid sequence
ctcaactggtgtcgtggagtcggcaattcagttgagccagcagc

SEQ ID NO: 372 - DNA, 44 bp, Artificial sequence
  Synthetic nucleic acid sequence
ctcaactggtgtcgtggagtcggcaattcagttgagacacttac

SEQ ID NO: 373 - DNA, 44 bp, Artificial sequence
  Synthetic nucleic acid sequence
ctcaactggtgtcgtggagtcggcaattcagttgagctggagga

SEQ ID NO: 374 - DNA, 44 bp, Artificial sequence
  Synthetic nucleic acid sequence
ctcaactggtgtcgtggagtcggcaattcagttgagaaagaggt

SEQ ID NO: 375 - DNA, 44 bp, Artificial sequence
  Synthetic nucleic acid sequence
ctcaactggtgtcgtggagtcggcaattcagttgagtctctgca

SEQ ID NO: 376 - DNA, 44 bp, Artificial sequence
  Synthetic nucleic acid sequence
ctcaactggtgtcgtggagtcggcaattcagttgaggaagaaag

SEQ ID NO: 377 - DNA, 44 bp, Artificial sequence
  Synthetic nucleic acid sequence
ctcaactggtgtcgtggagtcggcaattcagttgagaactcctg

SEQ ID NO: 378 - DNA, 44 bp, Artificial sequence
  Synthetic nucleic acid sequence
ctcaactggtgtcgtggagtcggcaattcagttgagcggctctg

SEQ ID NO: 379 - DNA, 44 bp, Artificial sequence
  Synthetic nucleic acid sequence
ctcaactggtgtcgtggagtcggcaattcagttgaggcaatgca

SEQ ID NO: 380 - DNA, 44 bp, Artificial sequence
  Synthetic nucleic acid sequence
ctcaactggtgtcgtggagtcggcaattcagttgagtcaatcac

SEQ ID NO: 381 - DNA, 44 bp, Artificial sequence
  Synthetic nucleic acid sequence
ctcaactggtgtcgtggagtcggcaattcagttgaggagccctg

SEQ ID NO: 382 - DNA, 44 bp, Artificial sequence
  Synthetic nucleic acid sequence
ctcaactggtgtcgtggagtcggcaattcagttgagagaggcag

SEQ ID NO: 383 - DNA, 44 bp, Artificial sequence
  Synthetic nucleic acid sequence
ctcaactggtgtcgtggagtcggcaattcagttgagatggcagt

SEQ ID NO: 384 - DNA, 44 bp, Artificial sequence
  Synthetic nucleic acid sequence
ctcaactggtgtcgtggagtcggcaattcagttgagcctggccg

SEQ ID NO: 385 - DNA, 44 bp, Artificial sequence
  Synthetic nucleic acid sequence
ctcaactggtgtcgtggagtcggcaattcagttgagaaatcaga

SEQ ID NO: 386 - DNA, 44 bp, Artificial sequence
  Synthetic nucleic acid sequence
ctcaactggtgtcgtggagtcggcaattcagttgagtgaatcct

SEQ ID NO: 387 - DNA, 44 bp, Artificial sequence
  Synthetic nucleic acid sequence
ctcaactggtgtcgtggagtcggcaattcagttgagactcacac

SEQ ID NO: 388 - DNA, 44 bp, Artificial sequence; identical to SEQ ID NO: 127
  Synthetic nucleic acid sequence

SEQ ID NO: 389 - DNA, 44 bp, Artificial sequence
  Synthetic nucleic acid sequence
ctcaactggtgtcgtggagtcggcaattcagttgagagtgcccc

SEQ ID NO: 390 - DNA, 44 bp, Artificial sequence
  Synthetic nucleic acid sequence
ctcaactggtgtcgtggagtcggcaattcagttgagacgctcaa

SEQ ID NO: 391 - DNA, 44 bp, Artificial sequence
  Synthetic nucleic acid sequence
ctcaactggtgtcgtggagtcggcaattcagttgagacacccca

SEQ ID NO: 392 - DNA, 44 bp, Artificial sequence
  Synthetic nucleic acid sequence
ctcaactggtgtcgtggagtcggcaattcagttgagcacttatc

SEQ ID NO: 393 - DNA, 44 bp, Artificial sequence
  Synthetic nucleic acid sequence
ctcaactggtgtcgtggagtcggcaattcagttgagacgtggat

SEQ ID NO: 394 - DNA, 44 bp, Artificial sequence
  Synthetic nucleic acid sequence
ctcaactggtgtcgtggagtcggcaattcagttgagaacatgga

SEQ ID NO: 395 - DNA, 44 bp, Artificial sequence
  Synthetic nucleic acid sequence
ctcaactggtgtcgtggagtcggcaattcagttgagacgtggaa

SEQ ID NO: 396 - DNA, 44 bp, Artificial sequence
  Synthetic nucleic acid sequence
ctcaactggtgtcgtggagtcggcaattcagttgagaagatgtg

SEQ ID NO: 397 - DNA, 44 bp, Artificial sequence
  Synthetic nucleic acid sequence
ctcaactggtgtcgtggagtcggcaattcagttgagagccacaa

SEQ ID NO: 398 - DNA, 44 bp, Artificial sequence
  Synthetic nucleic acid sequence
ctcaactggtgtcgtggagtcggcaattcagttgagtatgaaca

SEQ ID NO: 399 - DNA, 44 bp, Artificial sequence
  Synthetic nucleic acid sequence
ctcaactggtgtcgtggagtcggcaattcagttgagacggctag

SEQ ID NO: 400 - DNA, 44 bp, Artificial sequence
  Synthetic nucleic acid sequence
ctcaactggtgtcgtggagtcggcaattcagttgaggccttctg

SEQ ID NO: 401 - DNA, 44 bp, Artificial sequence
  Synthetic nucleic acid sequence
ctcaactggtgtcgtggagtcggcaattcagttgagttcaaaac

SEQ ID NO: 402 - DNA, 44 bp, Artificial sequence
  Synthetic nucleic acid sequence
ctcaactggtgtcgtggagtcggcaattcagttgagacggtttt

SEQ ID NO: 403 - DNA, 44 bp, Artificial sequence
  Synthetic nucleic acid sequence
ctcaactggtgtcgtggagtcggcaattcagttgagccacccaa

SEQ ID NO: 404 - DNA, 44 bp, Artificial sequence
  Synthetic nucleic acid sequence
ctcaactggtgtcgtggagtcggcaattcagttgaggccagcta

SEQ ID NO: 405 - DNA, 44 bp, Artificial sequence
  Synthetic nucleic acid sequence
ctcaactggtgtcgtggagtcggcaattcagttgagtatggatg

SEQ ID NO: 406 - DNA, 44 bp, Artificial sequence
  Synthetic nucleic acid sequence
ctcaactggtgtcgtggagtcggcaattcagttgagtattcagg

SEQ ID NO: 407 - DNA, 44 bp, Artificial sequence
  Synthetic nucleic acid sequence
ctcaactggtgtcgtggagtcggcaattcagttgagtcagtttc

SEQ ID NO: 408 - DNA, 44 bp, Artificial sequence
  Synthetic nucleic acid sequence
ctcaactggtgtcgtggagtcggcaattcagttgagtgcgaact

SEQ ID NO: 409 - DNA, 44 bp, Artificial sequence
  Synthetic nucleic acid sequence
ctcaactggtgtcgtggagtcggcaattcagttgagaccctata

SEQ ID NO: 410 - DNA, 44 bp, Artificial sequence
  Synthetic nucleic acid sequence
ctcaactggtgtcgtggagtcggcaattcagttgaggtgtatat

SEQ ID NO: 411 - DNA, 44 bp, Artificial sequence
  Synthetic nucleic acid sequence
ctcaactggtgtcgtggagtcggcaattcagttgagcgatgtag

SEQ ID NO: 412 - DNA, 44 bp, Artificial sequence
  Synthetic nucleic acid sequence
ctcaactggtgtcgtggagtcggcaattcagttgagaagacggg

SEQ ID NO: 413 - DNA, 44 bp, Artificial sequence
  Synthetic nucleic acid sequence
ctcaactggtgtcgtggagtcggcaattcagttgagctcccttc

SEQ ID NO: 414 - DNA, 44 bp, Artificial sequence
  Synthetic nucleic acid sequence
ctcaactggtgtcgtggagtcggcaattcagttgagagagagga

SEQ ID NO: 415 - DNA, 44 bp, Artificial sequence
  Synthetic nucleic acid sequence
ctcaactggtgtcgtggagtcggcaattcagttgagatcctgta

SEQ ID NO: 416 - DNA, 44 bp, Artificial sequence
  Synthetic nucleic acid sequence
ctcaactggtgtcgtggagtcggcaattcagttgagaactggat

SEQ ID NO: 417 - DNA, 44 bp, Artificial sequence
  Synthetic nucleic acid sequence
ctcaactggtgtcgtggagtcggcaattcagttgaggaccaaga

SEQ ID NO: 418 - DNA, 44 bp, Artificial sequence
  Synthetic nucleic acid sequence
ctcaactggtgtcgtggagtcggcaattcagttgaggctgccgt

SEQ ID NO: 419 - DNA, 44 bp, Artificial sequence
  Synthetic nucleic acid sequence
ctcaactggtgtcgtggagtcggcaattcagttgagacccacct

SEQ ID NO: 420 - DNA, 44 bp, Artificial sequence
  Synthetic nucleic acid sequence
ctcaactggtgtcgtggagtcggcaattcagttgaggtagaagg

SEQ ID NO: 421 - DNA, 44 bp, Artificial sequence
  Synthetic nucleic acid sequence
ctcaactggtgtcgtggagtcggcaattcagttgagaagaatct

SEQ ID NO: 422 - DNA, 44 bp, Artificial sequence
  Synthetic nucleic acid sequence
ctcaactggtgtcgtggagtcggcaattcagttgagcctggcac

SEQ ID NO: 423 - DNA, 44 bp, Artificial sequence
  Synthetic nucleic acid sequence
ctcaactggtgtcgtggagtcggcaattcagttgagacaaacca

SEQ ID NO: 424 - DNA, 44 bp, Artificial sequence
  Synthetic nucleic acid sequence
ctcaactggtgtcgtggagtcggcaattcagttgaggaaaaacg

SEQ ID NO: 425 - DNA, 44 bp, Artificial sequence
  Synthetic nucleic acid sequence
ctcaactggtgtcgtggagtcggcaattcagttgagagcacaga

SEQ ID NO: 426 - DNA, 44 bp, Artificial sequence
  Synthetic nucleic acid sequence
ctcaactggtgtcgtggagtcggcaattcagttgagtctcaccc

SEQ ID NO: 427 - DNA, 44 bp, Artificial sequence
  Synthetic nucleic acid sequence
ctcaactggtgtcgtggagtcggcaattcagttgagagaatcct

SEQ ID NO: 428 - DNA, 44 bp, Artificial sequence; identical to SEQ ID NO: 426
  Synthetic nucleic acid sequence

SEQ ID NO: 429 - DNA, 44 bp, Artificial sequence; identical to SEQ ID NO: 386
  Synthetic nucleic acid sequence

SEQ ID NO: 430 - DNA, 44 bp, Artificial sequence
  Synthetic nucleic acid sequence
ctcaactggtgtcgtggagtcggcaattcagttgagtagcaccc

SEQ ID NO: 431 - DNA, 44 bp, Artificial sequence
  Synthetic nucleic acid sequence
ctcaactggtgtcgtggagtcggcaattcagttgagctgcagaa

SEQ ID NO: 432 - DNA, 44 bp, Artificial sequence
  Synthetic nucleic acid sequence
ctcaactggtgtcgtggagtcggcaattcagttgagaggaaacc

SEQ ID NO: 433 - DNA, 44 bp, Artificial sequence
  Synthetic nucleic acid sequence
ctcaactggtgtcgtggagtcggcaattcagttgagtctactca

SEQ ID NO: 434 - DNA, 44 bp, Artificial sequence
  Synthetic nucleic acid sequence
ctcaactggtgtcgtggagtcggcaattcagttgagttcactcc

SEQ ID NO: 435 - DNA, 44 bp, Artificial sequence
  Synthetic nucleic acid sequence
ctcaactggtgtcgtggagtcggcaattcagttgagtctactcc

SEQ ID NO: 436 - DNA, 44 bp, Artificial sequence
  Synthetic nucleic acid sequence
ctcaactggtgtcgtggagtcggcaattcagttgagcatgagtg

SEQ ID NO: 437 - DNA, 44 bp, Artificial sequence
  Synthetic nucleic acid sequence
ctcaactggtgtcgtggagtcggcaattcagttgagcatgattg

SEQ ID NO: 438 - DNA, 44 bp, Artificial sequence
  Synthetic nucleic acid sequence
ctcaactggtgtcgtggagtcggcaattcagttgagctacccac

SEQ ID NO: 439 - DNA, 44 bp, Artificial sequence
  Synthetic nucleic acid sequence
ctcaactggtgtcgtggagtcggcaattcagttgagtgattgcc

SEQ ID NO: 440 - DNA, 44 bp, Artificial sequence
  Synthetic nucleic acid sequence
ctcaactggtgtcgtggagtcggcaattcagttgaggtgattgc

SEQ ID NO: 441 - DNA, 44 bp, Artificial sequence
  Synthetic nucleic acid sequence
ctcaactggtgtcgtggagtcggcaattcagttgagtgactgca

SEQ ID NO: 442 - DNA, 44 bp, Artificial sequence
  Synthetic nucleic acid sequence
ctcaactggtgtcgtggagtcggcaattcagttgaggacctcag

SEQ ID NO: 443 - DNA, 44 bp, Artificial sequence; identical to SEQ ID NO: 329
  Synthetic nucleic acid sequence

SEQ ID NO: 444 - DNA, 44 bp, Artificial sequence
  Synthetic nucleic acid sequence
ctcaactggtgtcgtggagtcggcaattcagttgagccttctca

SEQ ID NO: 445 - DNA, 44 bp, Artificial sequence
  Synthetic nucleic acid sequence
ctcaactggtgtcgtggagtcggcaattcagttgagatgacacc

SEQ ID NO: 446 - DNA, 44 bp, Artificial sequence
  Synthetic nucleic acid sequence
ctcaactggtgtcgtggagtcggcaattcagttgagataaatga

SEQ ID NO: 447 - DNA, 44 bp, Artificial sequence
  Synthetic nucleic acid sequence
ctcaactggtgtcgtggagtcggcaattcagttgagataaacga

SEQ ID NO: 448 - DNA, 44 bp, Artificial sequence; identical to SEQ ID NO: 433
  Synthetic nucleic acid sequence

SEQ ID NO: 449 - DNA, 44 bp, Artificial sequence
  Synthetic nucleic acid sequence
ctcaactggtgtcgtggagtcggcaattcagttgagaacgctcc

SEQ ID NO: 450 - DNA, 44 bp, Artificial sequence
  Synthetic nucleic acid sequence
ctcaactggtgtcgtggagtcggcaattcagttgagcagaaagt

SEQ ID NO: 451 - DNA, 44 bp, Artificial sequence
  Synthetic nucleic acid sequence
ctcaactggtgtcgtggagtcggcaattcagttgagaccctctg

SEQ ID NO: 452 - DNA, 44 bp, Artificial sequence; identical to SEQ ID NO: 329
  Synthetic nucleic acid sequence

SEQ ID NO: 453 - DNA, 44 bp, Artificial sequence
  Synthetic nucleic acid sequence
ctcaactggtgtcgtggagtcggcaattcagttgagaaagtgct

SEQ ID NO: 454 - DNA, 44 bp, Artificial sequence
  Synthetic nucleic acid sequence
ctcaactggtgtcgtggagtcggcaattcagttgagacactcta

SEQ ID NO: 455 - DNA, 44 bp, Artificial sequence
  Synthetic nucleic acid sequence
ctcaactggtgtcgtggagtcggcaattcagttgagaacactct

SEQ ID NO: 456 - DNA, 44 bp, Artificial sequence; identical to SEQ ID NO: 454
  Synthetic nucleic acid sequence

SEQ ID NO: 457 - DNA, 44 bp, Artificial sequence
  Synthetic nucleic acid sequence
ctcaactggtgtcgtggagtcggcaattcagttgagtccagcaa

SEQ ID NO: 458 - DNA, 44 bp, Artificial sequence
  Synthetic nucleic acid sequence
ctcaactggtgtcgtggagtcggcaattcagttgaggaaagggc

SEQ ID NO: 459 - DNA, 44 bp, Artificial sequence
  Synthetic nucleic acid sequence
ctcaactggtgtcgtggagtcggcaattcagttgagacctctaa

SEQ ID NO: 460 - DNA, 44 bp, Artificial sequence; identical to SEQ ID NO: 454
  Synthetic nucleic acid sequence

SEQ ID NO: 461 - DNA, 44 bp, Artificial sequence
  Synthetic nucleic acid sequence
ctcaactggtgtcgtggagtcggcaattcagttgaggctccaaa

SEQ ID NO: 462 - DNA, 44 bp, Artificial sequence; identical to SEQ ID NO: 450
  Synthetic nucleic acid sequence

SEQ ID NO: 463 - DNA, 44 bp, Artificial sequence
  Synthetic nucleic acid sequence
ctcaactggtgtcgtggagtcggcaattcagttgagcactctga

SEQ ID NO: 464 - DNA, 44 bp, Artificial sequence
  Synthetic nucleic acid sequence
ctcaactggtgtcgtggagtcggcaattcagttgagcctctaaa

SEQ ID NO: 465 - DNA, 44 bp, Artificial sequence; identical to SEQ ID NO: 454
  Synthetic nucleic acid sequence

SEQ ID NO: 466 - DNA, 44 bp, Artificial sequence
  Synthetic nucleic acid sequence
ctcaactggtgtcgtggagtcggcaattcagttgagaacctcta

SEQ ID NO: 467 - DNA, 44 bp, Artificial sequence
  Synthetic nucleic acid sequence
ctcaactggtgtcgtggagtcggcaattcagttgagcagaaagc

SEQ ID NO: 468 - DNA, 44 bp, Artificial sequence
  Synthetic nucleic acid sequence
ctcaactggtgtcgtggagtcggcaattcagttgagatcctcta

SEQ ID NO: 469 - DNA, 44 bp, Artificial sequence; identical to SEQ ID NO: 467
  Synthetic nucleic acid sequence

SEQ ID NO: 470 - DNA, 44 bp, Artificial sequence
  Synthetic nucleic acid sequence
ctcaactggtgtcgtggagtcggcaattcagttgagcactctaa

SEQ ID NO: 471 - DNA, 44 bp, Artificial sequence; identical to SEQ ID NO: 455
  Synthetic nucleic acid sequence

SEQ ID NO: 472 - DNA, 44 bp, Artificial sequence
  Synthetic nucleic acid sequence
ctcaactggtgtcgtggagtcggcaattcagttgagacagtcca

SEQ ID NO: 473 - DNA, 44 bp, Artificial sequence
  Synthetic nucleic acid sequence
ctcaactggtgtcgtggagtcggcaattcagttgagagaaagta

SEQ ID NO: 474 - DNA, 44 bp, Artificial sequence
  Synthetic nucleic acid sequence
ctcaactggtgtcgtggagtcggcaattcagttgagccctctaa

SEQ ID NO: 475 - DNA, 44 bp, Artificial sequence
  Synthetic nucleic acid sequence
ctcaactggtgtcgtggagtcggcaattcagttgagaccctcta

SEQ ID NO: 476 - DNA, 44 bp, Artificial sequence; identical to SEQ ID NO: 450
  Synthetic nucleic acid sequence

SEQ ID NO: 477 - DNA, 44 bp, Artificial sequence
  Synthetic nucleic acid sequence
ctcaactggtgtcgtggagtcggcaattcagttgagacccacca

SEQ ID NO: 478 - DNA, 44 bp, Artificial sequence; identical to SEQ ID NO: 458
  Synthetic nucleic acid sequence

SEQ ID NO: 479 - DNA, 44 bp, Artificial sequence
  Synthetic nucleic acid sequence
ctcaactggtgtcgtggagtcggcaattcagttgagccctcaaa

SEQ ID NO: 480 - DNA, 44 bp, Artificial sequence
  Synthetic nucleic acid sequence
ctcaactggtgtcgtggagtcggcaattcagttgagaaccctct

SEQ ID NO: 481 - DNA, 44 bp, Artificial sequence; identical to SEQ ID NO: 454
  Synthetic nucleic acid sequence

SEQ ID NO: 482 - DNA, 44 bp, Artificial sequence
  Synthetic nucleic acid sequence
ctcaactggtgtcgtggagtcggcaattcagttgagactctaaa

SEQ ID NO: 483 - DNA, 44 bp, Artificial sequence; identical to SEQ ID NO: 454
  Synthetic nucleic acid sequence

SEQ ID NO: 484 - DNA, 44 bp, Artificial sequence; identical to SEQ ID NO: 454
  Synthetic nucleic acid sequence

SEQ ID NO: 485 - DNA, 44 bp, Artificial sequence; identical to SEQ ID NO: 475
  Synthetic nucleic acid sequence

SEQ ID NO: 486 - DNA, 44 bp, Artificial sequence
  Synthetic nucleic acid sequence
ctcaactggtgtcgtggagtcggcaattcagttgagactccaaa

SEQ ID NO: 487 - DNA, 44 bp, Artificial sequence
  Synthetic nucleic acid sequence
ctcaactggtgtcgtggagtcggcaattcagttgaggagaaagt

SEQ ID NO: 488 - DNA, 44 bp, Artificial sequence
  Synthetic nucleic acid sequence
ctcaactggtgtcgtggagtcggcaattcagttgagcgctctaa

SEQ ID NO: 489 - DNA, 44 bp, Artificial sequence
  Synthetic nucleic acid sequence
ctcaactggtgtcgtggagtcggcaattcagttgagagaaagtg

SEQ ID NO: 490 - DNA, 44 bp, Artificial sequence; identical to SEQ ID NO: 450
  Synthetic nucleic acid sequence

SEQ ID NO: 491 - DNA, 44 bp, Artificial sequence
  Synthetic nucleic acid sequence
ctcaactggtgtcgtggagtcggcaattcagttgagacagaaag

SEQ ID NO: 492 - DNA, 44 bp, Artificial sequence; identical to SEQ ID NO: 458
  Synthetic nucleic acid sequence

SEQ ID NO: 493 - DNA, 44 bp, Artificial sequence
  Synthetic nucleic acid sequence
ctcaactggtgtcgtggagtcggcaattcagttgagagtccaga

SEQ ID NO: 494 - DNA, 44 bp, Artificial sequence
  Synthetic nucleic acid sequence
ctcaactggtgtcgtggagtcggcaattcagttgagtctcgtga

SEQ ID NO: 495 - DNA, 44 bp, Artificial sequence
  Synthetic nucleic acid sequence
ctcaactggtgtcgtggagtcggcaattcagttgaggaacttgc

SEQ ID NO: 496 - DNA, 44 bp, Artificial sequence
  Synthetic nucleic acid sequence
ctcaactggtgtcgtggagtcggcaattcagttgaggcacacaa

SEQ ID NO: 497 - DNA, 44 bp, Artificial sequence
  Synthetic nucleic acid sequence
ctcaactggtgtcgtggagtcggcaattcagttgaggcaaaagt

SEQ ID NO: 498 - DNA, 44 bp, Artificial sequence
  Synthetic nucleic acid sequence
ctcaactggtgtcgtggagtcggcaattcagttgagggtaaaac

SEQ ID NO: 499 - DNA, 44 bp, Artificial sequence
  Synthetic nucleic acid sequence
ctcaactggtgtcgtggagtcggcaattcagttgagacaaaagc

SEQ ID NO: 500 - DNA, 44 bp, Artificial sequence
  Synthetic nucleic acid sequence
ctcaactggtgtcgtggagtcggcaattcagttgagggccaaaa

SEQ ID NO: 501 - DNA, 44 bp, Artificial sequence; identical to SEQ ID NO: 497
  Synthetic nucleic acid sequence

SEQ ID NO: 502 - DNA, 44 bp, Artificial sequence
  Synthetic nucleic acid sequence
ctcaactggtgtcgtggagtcggcaattcagttgagggcaaaaa

SEQ ID NO: 503 - DNA, 44 bp, Artificial sequence
  Synthetic nucleic acid sequence
ctcaactggtgtcgtggagtcggcaattcagttgaggcaaaaga

SEQ ID NO: 504 - DNA, 44 bp, Artificial sequence; identical to SEQ ID NO: 502
  Synthetic nucleic acid sequence

SEQ ID NO: 505 - DNA, 44 bp, Artificial sequence
  Synthetic nucleic acid sequence
ctcaactggtgtcgtggagtcggcaattcagttgagtgcaaaag

SEQ ID NO: 506 - DNA, 44 bp, Artificial sequence
  Synthetic nucleic acid sequence
ctcaactggtgtcgtggagtcggcaattcagttgagaaaagtaa

SEQ ID NO: 507 - DNA, 44 bp, Artificial sequence
  Synthetic nucleic acid sequence
ctcaactggtgtcgtggagtcggcaattcagttgaggtacaaaa

SEQ ID NO: 508 - DNA, 44 bp, Artificial sequence
  Synthetic nucleic acid sequence
ctcaactggtgtcgtggagtcggcaattcagttgaggacaaaaa

SEQ ID NO: 509 - DNA, 44 bp, Artificial sequence
  Synthetic nucleic acid sequence
ctcaactggtgtcgtggagtcggcaattcagttgagggcaaaat

SEQ ID NO: 510 - DNA, 44 bp, Artificial sequence
  Synthetic nucleic acid sequence
ctcaactggtgtcgtggagtcggcaattcagttgagaccaaaga

SEQ ID NO: 511 - DNA, 44 bp, Artificial sequence
  Synthetic nucleic acid sequence
ctcaactggtgtcgtggagtcggcaattcagttgagagcaaaat

SEQ ID NO: 512 - DNA, 44 bp, Artificial sequence
  Synthetic nucleic acid sequence
ctcaactggtgtcgtggagtcggcaattcagttgaggacaaaac

SEQ ID NO: 513 - DNA, 44 bp, Artificial sequence
  Synthetic nucleic acid sequence
ctcaactggtgtcgtggagtcggcaattcagttgagcaaaaacc

SEQ ID NO: 514 - DNA, 44 bp, Artificial sequence
  Synthetic nucleic acid sequence
ctcaactggtgtcgtggagtcggcaattcagttgagacaaaatc

SEQ ID NO: 515 - DNA, 44 bp, Artificial sequence; identical to SEQ ID NO: 497
  Synthetic nucleic acid sequence

SEQ ID NO: 516 - DNA, 44 bp, Artificial sequence
  Synthetic nucleic acid sequence
ctcaactggtgtcgtggagtcggcaattcagttgagaaagtaac

SEQ ID NO: 517 - DNA, 44 bp, Artificial sequence
  Synthetic nucleic acid sequence
ctcaactggtgtcgtggagtcggcaattcagttgagagagctca

SEQ ID NO: 518 - DNA, 44 bp, Artificial sequence
  Synthetic nucleic acid sequence
ctcaactggtgtcgtggagtcggcaattcagttgaggggctctt

SEQ ID NO: 519 - DNA, 44 bp, Artificial sequence
  Synthetic nucleic acid sequence
ctcaactggtgtcgtggagtcggcaattcagttgagtggaaacc

SEQ ID NO: 520 - DNA, 44 bp, Artificial sequence
  Synthetic nucleic acid sequence
ctcaactggtgtcgtggagtcggcaattcagttgagttgtctaa

SEQ ID NO: 521 - DNA, 44 bp, Artificial sequence
  Synthetic nucleic acid sequence
ctcaactggtgtcgtggagtcggcaattcagttgagaaaacaaa

SEQ ID NO: 522 - DNA, 44 bp, Artificial sequence
  Synthetic nucleic acid sequence
ctcaactggtgtcgtggagtcggcaattcagttgagactggctg

SEQ ID NO: 523 - DNA, 44 bp, Artificial sequence
  Synthetic nucleic acid sequence
ctcaactggtgtcgtggagtcggcaattcagttgagatcagagg

SEQ ID NO: 524 - DNA, 44 bp, Artificial sequence
  Synthetic nucleic acid sequence
ctcaactggtgtcgtggagtcggcaattcagttgagaaagatga

SEQ ID NO: 525 - DNA, 44 bp, Artificial sequence
  Synthetic nucleic acid sequence
ctcaactggtgtcgtggagtcggcaattcagttgagctcatatt

SEQ ID NO: 526 - DNA, 44 bp, Artificial sequence
  Synthetic nucleic acid sequence
ctcaactggtgtcgtggagtcggcaattcagttgagagacaagg

SEQ ID NO: 527 - DNA, 44 bp, Artificial sequence
  Synthetic nucleic acid sequence
ctcaactggtgtcgtggagtcggcaattcagttgagattttggt

SEQ ID NO: 528 - DNA, 44 bp, Artificial sequence
  Synthetic nucleic acid sequence
ctcaactggtgtcgtggagtcggcaattcagttgagttttggtg

SEQ ID NO: 529 - DNA, 44 bp, Artificial sequence
  Synthetic nucleic acid sequence
ctcaactggtgtcgtggagtcggcaattcagttgagacttcaag

SEQ ID NO: 530 - DNA, 44 bp, Artificial sequence
  Synthetic nucleic acid sequence
ctcaactggtgtcgtggagtcggcaattcagttgaggcaaatgg

SEQ ID NO: 531 - DNA, 44 bp, Artificial sequence
  Synthetic nucleic acid sequence
ctcaactggtgtcgtggagtcggcaattcagttgaggggaaacg

SEQ ID NO: 532 - DNA, 44 bp, Artificial sequence
  Synthetic nucleic acid sequence
ctcaactggtgtcgtggagtcggcaattcagttgaggcctgctg

SEQ ID NO: 533 - DNA, 44 bp, Artificial sequence
  Synthetic nucleic acid sequence
ctcaactggtgtcgtggagtcggcaattcagttgaggttgggat

SEQ ID NO: 534 - DNA, 44 bp, Artificial sequence
  Synthetic nucleic acid sequence
ctcaactggtgtcgtggagtcggcaattcagttgaggttctgtc

SEQ ID NO: 535 - DNA, 44 bp, Artificial sequence
  Synthetic nucleic acid sequence
ctcaactggtgtcgtggagtcggcaattcagttgagactttcca

SEQ ID NO: 536 - DNA, 44 bp, Artificial sequence
  Synthetic nucleic acid sequence
ctcaactggtgtcgtggagtcggcaattcagttgaggcaaaggt

SEQ ID NO: 537 - DNA, 44 bp, Artificial sequence
  Synthetic nucleic acid sequence
ctcaactggtgtcgtggagtcggcaattcagttgagctcactca

SEQ ID NO: 538 - DNA, 44 bp, Artificial sequence
  Synthetic nucleic acid sequence
ctcaactggtgtcgtggagtcggcaattcagttgagtgggccac

SEQ ID NO: 539 - DNA, 44 bp, Artificial sequence
  Synthetic nucleic acid sequence
ctcaactggtgtcgtggagtcggcaattcagttgagctgatcag

SEQ ID NO: 540 - DNA, 44 bp, Artificial sequence
  Synthetic nucleic acid sequence
ctcaactggtgtcgtggagtcggcaattcagttgaggctcctgt

SEQ ID NO: 541 - DNA, 44 bp, Artificial sequence
  Synthetic nucleic acid sequence
ctcaactggtgtcgtggagtcggcaattcagttgaggattccaa

SEQ ID NO: 542 - DNA, 44 bp, Artificial sequence
  Synthetic nucleic acid sequence
ctcaactggtgtcgtggagtcggcaattcagttgagaaagacgt

SEQ ID NO: 543 - DNA, 44 bp, Artificial sequence
  Synthetic nucleic acid sequence
ctcaactggtgtcgtggagtcggcaattcagttgagcaggtacc

SEQ ID NO: 544 - DNA, 44 bp, Artificial sequence
  Synthetic nucleic acid sequence
ctcaactggtgtcgtggagtcggcaattcagttgagacaatcct

SEQ ID NO: 545 - DNA, 44 bp, Artificial sequence
  Synthetic nucleic acid sequence
ctcaactggtgtcgtggagtcggcaattcagttgagaatcgcgg

SEQ ID NO: 546 - DNA, 44 bp, Artificial sequence
  Synthetic nucleic acid sequence
ctcaactggtgtcgtggagtcggcaattcagttgagcctaatga

SEQ ID NO: 547 - DNA, 44 bp, Artificial sequence
  Synthetic nucleic acid sequence
ctcaactggtgtcgtggagtcggcaattcagttgagactgatct

SEQ ID NO: 548 - DNA, 44 bp, Artificial sequence
  Synthetic nucleic acid sequence
ctcaactggtgtcgtggagtcggcaattcagttgagggttcagt

SEQ ID NO: 549 - DNA, 44 bp, Artificial sequence
  Synthetic nucleic acid sequence
ctcaactggtgtcgtggagtcggcaattcagttgagagtaactg

SEQ ID NO: 550 - DNA, 44 bp, Artificial sequence
  Synthetic nucleic acid sequence
ctcaactggtgtcgtggagtcggcaattcagttgaggtaatggg

SEQ ID NO: 551 - DNA, 44 bp, Artificial sequence
  Synthetic nucleic acid sequence
ctcaactggtgtcgtggagtcggcaattcagttgagctcagtcc

SEQ ID NO: 552 - DNA, 44 bp, Artificial sequence
  Synthetic nucleic acid sequence
ctcaactggtgtcgtggagtcggcaattcagttgagtagcatac

SEQ ID NO: 553 - DNA, 44 bp, Artificial sequence
  Synthetic nucleic acid sequence
ctcaactggtgtcgtggagtcggcaattcagttgagggacctaa

SEQ ID NO: 554 - DNA, 44 bp, Artificial sequence
  Synthetic nucleic acid sequence
ctcaactggtgtcgtggagtcggcaattcagttgaggtgactca

SEQ ID NO: 555 - DNA, 44 bp, Artificial sequence
  Synthetic nucleic acid sequence
ctcaactggtgtcgtggagtcggcaattcagttgaggttctaac

SEQ ID NO: 556 - DNA, 44 bp, Artificial sequence
  Synthetic nucleic acid sequence
ctcaactggtgtcgtggagtcggcaattcagttgagctcagagc

SEQ ID NO: 557 - DNA, 44 bp, Artificial sequence
  Synthetic nucleic acid sequence
ctcaactggtgtcgtggagtcggcaattcagttgagacaatgag

SEQ ID NO: 558 - DNA, 44 bp, Artificial sequence
  Synthetic nucleic acid sequence
ctcaactggtgtcgtggagtcggcaattcagttgagacatcatc

SEQ ID NO: 559 - DNA, 44 bp, Artificial sequence
  Synthetic nucleic acid sequence
ctcaactggtgtcgtggagtcggcaattcagttgagagaaaccc

SEQ ID NO: 560 - DNA, 44 bp, Artificial sequence
  Synthetic nucleic acid sequence
ctcaactggtgtcgtggagtcggcaattcagttgagagacacac

SEQ ID NO: 561 - DNA, 44 bp, Artificial sequence
  Synthetic nucleic acid sequence
ctcaactggtgtcgtggagtcggcaattcagttgagcccgagga

SEQ ID NO: 562 - DNA, 44 bp, Artificial sequence
  Synthetic nucleic acid sequence
ctcaactggtgtcgtggagtcggcaattcagttgagacagtggt

SEQ ID NO: 563 - DNA, 44 bp, Artificial sequence
  Synthetic nucleic acid sequence
ctcaactggtgtcgtggagtcggcaattcagttgagtgacgatg

SEQ ID NO: 564 - DNA, 44 bp, Artificial sequence
  Synthetic nucleic acid sequence
ctcaactggtgtcgtggagtcggcaattcagttgaggtttgata

SEQ ID NO: 565 - DNA, 44 bp, Artificial sequence
  Synthetic nucleic acid sequence
ctcaactggtgtcgtggagtcggcaattcagttgaggagcaagg

SEQ ID NO: 566 - DNA, 44 bp, Artificial sequence
  Synthetic nucleic acid sequence
ctcaactggtgtcgtggagtcggcaattcagttgagctcctcca

SEQ ID NO: 567 - DNA, 44 bp, Artificial sequence
  Synthetic nucleic acid sequence
ctcaactggtgtcgtggagtcggcaattcagttgaggggccgca

SEQ ID NO: 568 - DNA, 44 bp, Artificial sequence; identical to SEQ ID NO: 497
  Synthetic nucleic acid sequence

SEQ ID NO: 569 - DNA, 44 bp, Artificial sequence
  Synthetic nucleic acid sequence
ctcaactggtgtcgtggagtcggcaattcagttgaggtcctgaa

SEQ ID NO: 570 - DNA, 44 bp, Artificial sequence
  Synthetic nucleic acid sequence
ctcaactggtgtcgtggagtcggcaattcagttgagaggagaag

SEQ ID NO: 571 - DNA, 44 bp, Artificial sequence
  Synthetic nucleic acid sequence
ctcaactggtgtcgtggagtcggcaattcagttgagatctttga

SEQ ID NO: 572 - DNA, 44 bp, Artificial sequence
  Synthetic nucleic acid sequence
ctcaactggtgtcgtggagtcggcaattcagttgaggttataga

SEQ ID NO: 573 - DNA, 44 bp, Artificial sequence
  Synthetic nucleic acid sequence
ctcaactggtgtcgtggagtcggcaattcagttgagacggagct

SEQ ID NO: 574 - DNA, 44 bp, Artificial sequence
  Synthetic nucleic acid sequence
ctcaactggtgtcgtggagtcggcaattcagttgagagagatga

SEQ ID NO: 575 - DNA, 44 bp, Artificial sequence
  Synthetic nucleic acid sequence
ctcaactggtgtcgtggagtcggcaattcagttgagtcccagca

SEQ ID NO: 576 - DNA, 44 bp, Artificial sequence
  Synthetic nucleic acid sequence
ctcaactggtgtcgtggagtcggcaattcagttgaggtcagacc

SEQ ID NO: 577 - DNA, 44 bp, Artificial sequence
  Synthetic nucleic acid sequence
ctcaactggtgtcgtggagtcggcaattcagttgagaaggagct

SEQ ID NO: 578 - DNA, 44 bp, Artificial sequence
  Synthetic nucleic acid sequence
ctcaactggtgtcgtggagtcggcaattcagttgagggcaaaga

SEQ ID NO: 579 - DNA, 44 bp, Artificial sequence
  Synthetic nucleic acid sequence
ctcaactggtgtcgtggagtcggcaattcagttgagccacctgg

SEQ ID NO: 580 - DNA, 44 bp, Artificial sequence
  Synthetic nucleic acid sequence
ctcaactggtgtcgtggagtcggcaattcagttgagctgctcaa

SEQ ID NO: 581 - DNA, 44 bp, Artificial sequence
  Synthetic nucleic acid sequence
ctcaactggtgtcgtggagtcggcaattcagttgaggccacctt

SEQ ID NO: 582 - DNA, 44 bp, Artificial sequence
  Synthetic nucleic acid sequence
ctcaactggtgtcgtggagtcggcaattcagttgagactcagaa

SEQ ID NO: 583 - DNA, 44 bp, Artificial sequence
  Synthetic nucleic acid sequence
ctcaactggtgtcgtggagtcggcaattcagttgagactgggca

SEQ ID NO: 584 - DNA, 44 bp, Artificial sequence
  Synthetic nucleic acid sequence
ctcaactggtgtcgtggagtcggcaattcagttgagatttctat

SEQ ID NO: 585 - DNA, 44 bp, Artificial sequence
  Synthetic nucleic acid sequence
ctcaactggtgtcgtggagtcggcaattcagttgagaggtaagc

SEQ ID NO: 586 - DNA, 44 bp, Artificial sequence
  Synthetic nucleic acid sequence
ctcaactggtgtcgtggagtcggcaattcagttgaggctccaac

SEQ ID NO: 587 - DNA, 44 bp, Artificial sequence
  Synthetic nucleic acid sequence
ctcaactggtgtcgtggagtcggcaattcagttgagacccaaca

SEQ ID NO: 588 - DNA, 44 bp, Artificial sequence
  Synthetic nucleic acid sequence
ctcaactggtgtcgtggagtcggcaattcagttgagaggtaata

SEQ ID NO: 589 - DNA, 44 bp, Artificial sequence
  Synthetic nucleic acid sequence
ctcaactggtgtcgtggagtcggcaattcagttgagggactata

SEQ ID NO: 590 - DNA, 44 bp, Artificial sequence
  Synthetic nucleic acid sequence
ctcaactggtgtcgtggagtcggcaattcagttgagaagacatt

SEQ ID NO: 591 - DNA, 44 bp, Artificial sequence
  Synthetic nucleic acid sequence
ctcaactggtgtcgtggagtcggcaattcagttgagtcctcttt

SEQ ID NO: 592 - DNA, 44 bp, Artificial sequence
  Synthetic nucleic acid sequence
ctcaactggtgtcgtggagtcggcaattcagttgagtcgactgc

SEQ ID NO: 593 - DNA, 44 bp, Artificial sequence
  Synthetic nucleic acid sequence
ctcaactggtgtcgtggagtcggcaattcagttgagcctctagt

SEQ ID NO: 594 - DNA, 44 bp, Artificial sequence
  Synthetic nucleic acid sequence
ctcaactggtgtcgtggagtcggcaattcagttgagagttctcc

SEQ ID NO: 595 - DNA, 44 bp, Artificial sequence
  Synthetic nucleic acid sequence
ctcaactggtgtcgtggagtcggcaattcagttgagaccttccc

SEQ ID NO: 596 - DNA, 44 bp, Artificial sequence
  Synthetic nucleic acid sequence
ctcaactggtgtcgtggagtcggcaattcagttgaggctgaggt

SEQ ID NO: 597 - DNA, 44 bp, Artificial sequence
  Synthetic nucleic acid sequence
ctcaactggtgtcgtggagtcggcaattcagttgagtcccacag

SEQ ID NO: 598 - DNA, 44 bp, Artificial sequence
  Synthetic nucleic acid sequence
ctcaactggtgtcgtggagtcggcaattcagttgagtttattgt

SEQ ID NO: 599 - DNA, 44 bp, Artificial sequence
  Synthetic nucleic acid sequence
ctcaactggtgtcgtggagtcggcaattcagttgaggtccaaag

SEQ ID NO: 600 - DNA, 44 bp, Artificial sequence
  Synthetic nucleic acid sequence
ctcaactggtgtcgtggagtcggcaattcagttgagggacattg

SEQ ID NO: 601 - DNA, 44 bp, Artificial sequence
  Synthetic nucleic acid sequence
ctcaactggtgtcgtggagtcggcaattcagttgagtgcgggcg

SEQ ID NO: 602 - DNA, 44 bp, Artificial sequence
  Synthetic nucleic acid sequence
ctcaactggtgtcgtggagtcggcaattcagttgagacgcagag

SEQ ID NO: 603 - DNA, 44 bp, Artificial sequence
  Synthetic nucleic acid sequence
ctcaactggtgtcgtggagtcggcaattcagttgagaggccgcc

SEQ ID NO: 604 - DNA, 44 bp, Artificial sequence
  Synthetic nucleic acid sequence
ctcaactggtgtcgtggagtcggcaattcagttgagacagcgct

SEQ ID NO: 605 - DNA, 44 bp, Artificial sequence; identical to SEQ ID NO: 382
  Synthetic nucleic acid sequence

SEQ ID NO: 606 - DNA, 44 bp, Artificial sequence
  Synthetic nucleic acid sequence
ctcaactggtgtcgtggagtcggcaattcagttgaggaggtgac

SEQ ID NO: 607 - DNA, 44 bp, Artificial sequence
  Synthetic nucleic acid sequence
ctcaactggtgtcgtggagtcggcaattcagttgagcaagacac

SEQ ID NO: 608 - DNA, 44 bp, Artificial sequence
  Synthetic nucleic acid sequence
ctcaactggtgtcgtggagtcggcaattcagttgagctacctga

SEQ ID NO: 609 - DNA, 44 bp, Artificial sequence
  Synthetic nucleic acid sequence
ctcaactggtgtcgtggagtcggcaattcagttgaggctctaag

SEQ ID NO: 610 - DNA, 44 bp, Artificial sequence
  Synthetic nucleic acid sequence
ctcaactggtgtcgtggagtcggcaattcagttgagtcagcagt

SEQ ID NO: 611 - DNA, 44 bp, Artificial sequence
  Synthetic nucleic acid sequence
ctcaactggtgtcgtggagtcggcaattcagttgaggcctcaga

SEQ ID NO: 612 - DNA, 44 bp, Artificial sequence
  Synthetic nucleic acid sequence
ctcaactggtgtcgtggagtcggcaattcagttgaggaaggaag

SEQ ID NO: 613 - DNA, 44 bp, Artificial sequence
  Synthetic nucleic acid sequence
ctcaactggtgtcgtggagtcggcaattcagttgagaccagtgc

SEQ ID NO: 614 - DNA, 44 bp, Artificial sequence
  Synthetic nucleic acid sequence
ctcaactggtgtcgtggagtcggcaattcagttgaggactcttg

SEQ ID NO: 615 - DNA, 44 bp, Artificial sequence
  Synthetic nucleic acid sequence
ctcaactggtgtcgtggagtcggcaattcagttgaggtcctgag

SEQ ID NO: 616 - DNA, 44 bp, Artificial sequence
  Synthetic nucleic acid sequence
ctcaactggtgtcgtggagtcggcaattcagttgagcaaaagtc

SEQ ID NO: 617 - DNA, 44 bp, Artificial sequence
  Synthetic nucleic acid sequence
ctcaactggtgtcgtggagtcggcaattcagttgaggcacatgt

SEQ ID NO: 618 - DNA, 44 bp, Artificial sequence; identical to SEQ ID NO: 374
  Synthetic nucleic acid sequence

SEQ ID NO: 619 - DNA, 44 bp, Artificial sequence
  Synthetic nucleic acid sequence
ctcaactggtgtcgtggagtcggcaattcagttgagagaggttg

SEQ ID NO: 620 - DNA, 44 bp, Artificial sequence
  Synthetic nucleic acid sequence
ctcaactggtgtcgtggagtcggcaattcagttgagcctagaga

SEQ ID NO: 621 - DNA, 44 bp, Artificial sequence
  Synthetic nucleic acid sequence
ctcaactggtgtcgtggagtcggcaattcagttgagaccaacgg

SEQ ID NO: 622 - DNA, 44 bp, Artificial sequence
  Synthetic nucleic acid sequence
ctcaactggtgtcgtggagtcggcaattcagttgagtggggacc

SEQ ID NO: 623 - DNA, 44 bp, Artificial sequence
  Synthetic nucleic acid sequence
ctcaactggtgtcgtggagtcggcaattcagttgagcaactccg

SEQ ID NO: 624 - DNA, 44 bp, Artificial sequence
  Synthetic nucleic acid sequence
ctcaactggtgtcgtggagtcggcaattcagttgagacgcgcag

SEQ ID NO: 625 - DNA, 44 bp, Artificial sequence
  Synthetic nucleic acid sequence
ctcaactggtgtcgtggagtcggcaattcagttgagctgctggg

SEQ ID NO: 626 - DNA, 44 bp, Artificial sequence
  Synthetic nucleic acid sequence
ctcaactggtgtcgtggagtcggcaattcagttgaggcggtccc

SEQ ID NO: 627 - DNA, 44 bp, Artificial sequence
  Synthetic nucleic acid sequence
ctcaactggtgtcgtggagtcggcaattcagttgagcctcaggc

SEQ ID NO: 628 - DNA, 44 bp, Artificial sequence
  Synthetic nucleic acid sequence
ctcaactggtgtcgtggagtcggcaattcagttgagtgtaggct

SEQ ID NO: 629 - DNA, 44 bp, Artificial sequence
  Synthetic nucleic acid sequence
ctcaactggtgtcgtggagtcggcaattcagttgagaggggcct

SEQ ID NO: 630 - DNA, 44 bp, Artificial sequence
  Synthetic nucleic acid sequence
ctcaactggtgtcgtggagtcggcaattcagttgaggtagtggg

SEQ ID NO: 631 - DNA, 44 bp, Artificial sequence
  Synthetic nucleic acid sequence
ctcaactggtgtcgtggagtcggcaattcagttgagcactgtgg

SEQ ID NO: 632 - DNA, 44 bp, Artificial sequence
  Synthetic nucleic acid sequence
ctcaactggtgtcgtggagtcggcaattcagttgagtggaggcc

SEQ ID NO: 633 - DNA, 44 bp, Artificial sequence
  Synthetic nucleic acid sequence
ctcaactggtgtcgtggagtcggcaattcagttgagggttagtg

SEQ ID NO: 634 - DNA, 44 bp, Artificial sequence
  Synthetic nucleic acid sequence
ctcaactggtgtcgtggagtcggcaattcagttgagcatcacct

SEQ ID NO: 635 - DNA, 44 bp, Artificial sequence
  Synthetic nucleic acid sequence
ctcaactggtgtcgtggagtcggcaattcagttgaggctgaggc

SEQ ID NO: 636 - DNA, 44 bp, Artificial sequence
  Synthetic nucleic acid sequence
ctcaactggtgtcgtggagtcggcaattcagttgagagaaacca

SEQ ID NO: 637 - DNA, 44 bp, Artificial sequence
  Synthetic nucleic acid sequence
ctcaactggtgtcgtggagtcggcaattcagttgagcatgctca

SEQ ID NO: 638 - DNA, 44 bp, Artificial sequence
  Synthetic nucleic acid sequence
ctcaactggtgtcgtggagtcggcaattcagttgaggtcagcag

SEQ ID NO: 639 - DNA, 44 bp, Artificial sequence
  Synthetic nucleic acid sequence
ctcaactggtgtcgtggagtcggcaattcagttgagatcactcc

SEQ ID NO: 640 - DNA, 44 bp, Artificial sequence
  Synthetic nucleic acid sequence
ctcaactggtgtcgtggagtcggcaattcagttgagaaccaaga

SEQ ID NO: 641 - DNA, 44 bp, Artificial sequence
  Synthetic nucleic acid sequence
ctcaactggtgtcgtggagtcggcaattcagttgagagctcaga

SEQ ID NO: 642 - DNA, 44 bp, Artificial sequence
  Synthetic nucleic acid sequence
ctcaactggtgtcgtggagtcggcaattcagttgagtggccctg

SEQ ID NO: 643 - DNA, 44 bp, Artificial sequence
  Synthetic nucleic acid sequence
ctcaactggtgtcgtggagtcggcaattcagttgagacaaggat

SEQ ID NO: 644 - DNA, 44 bp, Artificial sequence
  Synthetic nucleic acid sequence
ctcaactggtgtcgtggagtcggcaattcagttgagcacaacct

SEQ ID NO: 645 - DNA, 44 bp, Artificial sequence
  Synthetic nucleic acid sequence
ctcaactggtgtcgtggagtcggcaattcagttgagtgaattac

SEQ ID NO: 646 - DNA, 44 bp, Artificial sequence
  Synthetic nucleic acid sequence
ctcaactggtgtcgtggagtcggcaattcagttgagtggtgatt

SEQ ID NO: 647 - DNA, 44 bp, Artificial sequence
  Synthetic nucleic acid sequence
ctcaactggtgtcgtggagtcggcaattcagttgagtatccact

SEQ ID NO: 648 - DNA, 44 bp, Artificial sequence; identical to SEQ ID NO: 382
  Synthetic nucleic acid sequence

SEQ ID NO: 649 - DNA, 44 bp, Artificial sequence
  Synthetic nucleic acid sequence
ctcaactggtgtcgtggagtcggcaattcagttgagaagggtca

SEQ ID NO: 650 - DNA, 44 bp, Artificial sequence
  Synthetic nucleic acid sequence
ctcaactggtgtcgtggagtcggcaattcagttgagccgcttga

SEQ ID NO: 651 - DNA, 44 bp, Artificial sequence
  Synthetic nucleic acid sequence
ctcaactggtgtcgtggagtcggcaattcagttgagcctcggga

SEQ ID NO: 652 - DNA, 44 bp, Artificial sequence
  Synthetic nucleic acid sequence
ctcaactggtgtcgtggagtcggcaattcagttgagtgactgac

SEQ ID NO: 653 - DNA, 44 bp, Artificial sequence
  Synthetic nucleic acid sequence
ctcaactggtgtcgtggagtcggcaattcagttgagacaatggt

SEQ ID NO: 654 - DNA, 44 bp, Artificial sequence
  Synthetic nucleic acid sequence
ctcaactggtgtcgtggagtcggcaattcagttgagcaactgat

SEQ ID NO: 655 - DNA, 44 bp, Artificial sequence
  Synthetic nucleic acid sequence
ctcaactggtgtcgtggagtcggcaattcagttgagtcagtggc

SEQ ID NO: 656 - DNA, 44 bp, Artificial sequence
  Synthetic nucleic acid sequence
ctcaactggtgtcgtggagtcggcaattcagttgagtcaatgac

SEQ ID NO: 657 - DNA, 44 bp, Artificial sequence
  Synthetic nucleic acid sequence
ctcaactggtgtcgtggagtcggcaattcagttgagctacgcag

SEQ ID NO: 658 - DNA, 44 bp, Artificial sequence
  Synthetic nucleic acid sequence
ctcaactggtgtcgtggagtcggcaattcagttgagtctaccca

SEQ ID NO: 659 - DNA, 44 bp, Artificial sequence
  Synthetic nucleic acid sequence
ctcaactggtgtcgtggagtcggcaattcagttgagtactgctt

SEQ ID NO: 660 - DNA, 44 bp, Artificial sequence
  Synthetic nucleic acid sequence
ctcaactggtgtcgtggagtcggcaattcagttgaggaatcctg

SEQ ID NO: 661 - DNA, 44 bp, Artificial sequence
  Synthetic nucleic acid sequence
ctcaactggtgtcgtggagtcggcaattcagttgaggacgtagt

SEQ ID NO: 662 - DNA, 44 bp, Artificial sequence
  Synthetic nucleic acid sequence
ctcaactggtgtcgtggagtcggcaattcagttgagagtttctt

SEQ ID NO: 663 - DNA, 44 bp, Artificial sequence
  Synthetic nucleic acid sequence
ctcaactggtgtcgtggagtcggcaattcagttgaggcaagaca

SEQ ID NO: 664 - DNA, 44 bp, Artificial sequence
  Synthetic nucleic acid sequence
ctcaactggtgtcgtggagtcggcaattcagttgagacaggccg

SEQ ID NO: 665 - DNA, 44 bp, Artificial sequence; identical to SEQ ID NO: 298
  Synthetic nucleic acid sequence

SEQ ID NO: 666 - DNA, 44 bp, Artificial sequence
  Synthetic nucleic acid sequence
ctcaactggtgtcgtggagtcggcaattcagttgagccagtgtc

SEQ ID NO: 667 - DNA, 44 bp, Artificial sequence
  Synthetic nucleic acid sequence
ctcaactggtgtcgtggagtcggcaattcagttgaggcggtagc

SEQ ID NO: 668 - DNA, 44 bp, Artificial sequence
  Synthetic nucleic acid sequence
ctcaactggtgtcgtggagtcggcaattcagttgagctgcgatt

SEQ ID NO: 669 - DNA, 44 bp, Artificial sequence
  Synthetic nucleic acid sequence
ctcaactggtgtcgtggagtcggcaattcagttgagggcagaga

SEQ ID NO: 670 - DNA, 44 bp, Artificial sequence
  Synthetic nucleic acid sequence
ctcaactggtgtcgtggagtcggcaattcagttgagactgggtt

SEQ ID NO: 671 - DNA, 44 bp, Artificial sequence
  Synthetic nucleic acid sequence
ctcaactggtgtcgtggagtcggcaattcagttgagcaccccca

SEQ ID NO: 672 - DNA, 44 bp, Artificial sequence
  Synthetic nucleic acid sequence
ctcaactggtgtcgtggagtcggcaattcagttgagggggagcg

SEQ ID NO: 673 - DNA, 44 bp, Artificial sequence; identical to SEQ ID NO: 617
  Synthetic nucleic acid sequence

SEQ ID NO: 674 - DNA, 44 bp, Artificial sequence
  Synthetic nucleic acid sequence
ctcaactggtgtcgtggagtcggcaattcagttgagcacatggc

SEQ ID NO: 675 - DNA, 44 bp, Artificial sequence; identical to SEQ ID NO: 373
  Synthetic nucleic acid sequence

SEQ ID NO: 676 - DNA, 44 bp, Artificial sequence
  Synthetic nucleic acid sequence
ctcaactggtgtcgtggagtcggcaattcagttgagctcatccg

SEQ ID NO: 677 - DNA, 44 bp, Artificial sequence
  Synthetic nucleic acid sequence
ctcaactggtgtcgtggagtcggcaattcagttgagtgctcaat

SEQ ID NO: 678 - DNA, 44 bp, Artificial sequence
  Synthetic nucleic acid sequence
ctcaactggtgtcgtggagtcggcaattcagttgagttcagcta

SEQ ID NO: 679 - DNA, 44 bp, Artificial sequence
  Synthetic nucleic acid sequence
ctcaactggtgtcgtggagtcggcaattcagttgagaccacaag

SEQ ID NO: 680 - DNA, 44 bp, Artificial sequence; identical to SEQ ID NO: 60
  Synthetic nucleic acid sequence

SEQ ID NO: 681 - DNA, 44 bp, Artificial sequence
  Synthetic nucleic acid sequence
ctcaactggtgtcgtggagtcggcaattcagttgagcatgcctt

SEQ ID NO: 682 - DNA, 44 bp, Artificial sequence
  Synthetic nucleic acid sequence
ctcaactggtgtcgtggagtcggcaattcagttgagttacacac

SEQ ID NO: 683 - DNA, 44 bp, Artificial sequence
  Synthetic nucleic acid sequence
ctcaactggtgtcgtggagtcggcaattcagttgagtcctggcc

SEQ ID NO: 684 - DNA, 44 bp, Artificial sequence
  Synthetic nucleic acid sequence
ctcaactggtgtcgtggagtcggcaattcagttgaggacagagg

SEQ ID NO: 685 - DNA, 44 bp, Artificial sequence
  Synthetic nucleic acid sequence
ctcaactggtgtcgtggagtcggcaattcagttgagtagggcta

SEQ ID NO: 686 - DNA, 44 bp, Artificial sequence
  Synthetic nucleic acid sequence
ctcaactggtgtcgtggagtcggcaattcagttgagaatttggt

SEQ ID NO: 687 - DNA, 44 bp, Artificial sequence
  Synthetic nucleic acid sequence
ctcaactggtgtcgtggagtcggcaattcagttgaggatagtaa

SEQ ID NO: 688 - DNA, 44 bp, Artificial sequence
  Synthetic nucleic acid sequence
ctcaactggtgtcgtggagtcggcaattcagttgagaggatcta

SEQ ID NO: 689 - DNA, 44 bp, Artificial sequence
  Synthetic nucleic acid sequence
ctcaactggtgtcgtggagtcggcaattcagttgagtgagcagg

SEQ ID NO: 690 - DNA, 44 bp, Artificial sequence
  Synthetic nucleic acid sequence
ctcaactggtgtcgtggagtcggcaattcagttgagaggcagag

SEQ ID NO: 691 - DNA, 44 bp, Artificial sequence
  Synthetic nucleic acid sequence
ctcaactggtgtcgtggagtcggcaattcagttgagccaagcca

SEQ ID NO: 692 - DNA, 44 bp, Artificial sequence
  Synthetic nucleic acid sequence
ctcaactggtgtcgtggagtcggcaattcagttgagccgcgcga

SEQ ID NO: 693 - DNA, 44 bp, Artificial sequence
  Synthetic nucleic acid sequence
ctcaactggtgtcgtggagtcggcaattcagttgagctccacct

SEQ ID NO: 694 - DNA, 44 bp, Artificial sequence
  Synthetic nucleic acid sequence
ctcaactggtgtcgtggagtcggcaattcagttgagagctccca

SEQ ID NO: 695 - DNA, 44 bp, Artificial sequence
  Synthetic nucleic acid sequence
ctcaactggtgtcgtggagtcggcaattcagttgagcgcgtacc

SEQ ID NO: 696 - DNA, 44 bp, Artificial sequence
  Synthetic nucleic acid sequence
ctcaactggtgtcgtggagtcggcaattcagttgagtggaatgt

SEQ ID NO: 697 - DNA, 44 bp, Artificial sequence
  Synthetic nucleic acid sequence
ctcaactggtgtcgtggagtcggcaattcagttgagccatcatc

SEQ ID NO: 698 - DNA, 44 bp, Artificial sequence
  Synthetic nucleic acid sequence
ctcaactggtgtcgtggagtcggcaattcagttgagctccaaca

SEQ ID NO: 699 - DNA, 44 bp, Artificial sequence; identical to SEQ ID NO: 335
  Synthetic nucleic acid sequence

SEQ ID NO: 700 - DNA, 44 bp, Artificial sequence; identical to SEQ ID NO: 336
  Synthetic nucleic acid sequence

SEQ ID NO: 701 - DNA, 44 bp, Artificial sequence
  Synthetic nucleic acid sequence
ctcaactggtgtcgtggagtcggcaattcagttgagcggtgtga

SEQ ID NO: 702 - DNA, 44 bp, Artificial sequence
  Synthetic nucleic acid sequence
ctcaactggtgtcgtggagtcggcaattcagttgagctaacagc

SEQ ID NO: 703 - DNA, 44 bp, Artificial sequence; identical to SEQ ID NO: 343
  Synthetic nucleic acid sequence

SEQ ID NO: 704 - DNA, 44 bp, Artificial sequence
  Synthetic nucleic acid sequence
ctcaactggtgtcgtggagtcggcaattcagttgagaagaacaa

SEQ ID NO: 705 - DNA, 44 bp, Artificial sequence
  Synthetic nucleic acid sequence
ctcaactggtgtcgtggagtcggcaattcagttgagtcttccca

SEQ ID NO: 706 - DNA, 44 bp, Artificial sequence
  Synthetic nucleic acid sequence
ctcaactggtgtcgtggagtcggcaattcagttgagaaagaagt

SEQ ID NO: 707 - DNA, 44 bp, Artificial sequence
  Synthetic nucleic acid sequence
ctcaactggtgtcgtggagtcggcaattcagttgaggagggagg

SEQ ID NO: 708 - DNA, 44 bp, Artificial sequence
  Synthetic nucleic acid sequence
ctcaactggtgtcgtggagtcggcaattcagttgagaggcaaag

SEQ ID NO: 709 - DNA, 44 bp, Artificial sequence
  Synthetic nucleic acid sequence
ctcaactggtgtcgtggagtcggcaattcagttgagtggccgtg

SEQ ID NO: 710 - DNA, 44 bp, Artificial sequence; identical to SEQ ID NO: 349
  Synthetic nucleic acid sequence

SEQ ID NO: 711 - DNA, 44 bp, Artificial sequence
  Synthetic nucleic acid sequence
ctcaactggtgtcgtggagtcggcaattcagttgagtccagtca

SEQ ID NO: 712 - DNA, 44 bp, Artificial sequence
  Synthetic nucleic acid sequence
ctcaactggtgtcgtggagtcggcaattcagttgagaagtgtct

SEQ ID NO: 713 - DNA, 44 bp, Artificial sequence; identical to SEQ ID NO: 356
  Synthetic nucleic acid sequence

SEQ ID NO: 714 - DNA, 44 bp, Artificial sequence
  Synthetic nucleic acid sequence
ctcaactggtgtcgtggagtcggcaattcagttgaggggcttaa

SEQ ID NO: 715 - DNA, 44 bp, Artificial sequence
  Synthetic nucleic acid sequence
ctcaactggtgtcgtggagtcggcaattcagttgagaaagtgcc

SEQ ID NO: 716 - DNA, 44 bp, Artificial sequence; identical to SEQ ID NO: 496
  Synthetic nucleic acid sequence

SEQ ID NO: 717 - DNA, 44 bp, Artificial sequence
  Synthetic nucleic acid sequence
ctcaactggtgtcgtggagtcggcaattcagttgagagagaggg

SEQ ID NO: 718 - DNA, 44 bp, Artificial sequence
  Synthetic nucleic acid sequence
ctcaactggtgtcgtggagtcggcaattcagttgagacaaacaa

SEQ ID NO: 719 - DNA, 44 bp, Artificial sequence
  Synthetic nucleic acid sequence
ctcaactggtgtcgtggagtcggcaattcagttgagggagaggg

SEQ ID NO: 720 - DNA, 44 bp, Artificial sequence; identical to SEQ ID NO: 127
  Synthetic nucleic acid sequence

SEQ ID NO: 721 - DNA, 44 bp, Artificial sequence
  Synthetic nucleic acid sequence
ctcaactggtgtcgtggagtcggcaattcagttgagcaaaagag

SEQ ID NO: 722 - DNA, 44 bp, Artificial sequence
  Synthetic nucleic acid sequence
ctcaactggtgtcgtggagtcggcaattcagttgagacactaca

SEQ ID NO: 723 - DNA, 44 bp, Artificial sequence
  Synthetic nucleic acid sequence
ctcaactggtgtcgtggagtcggcaattcagttgagacacacaa

SEQ ID NO: 724 - DNA, 44 bp, Artificial sequence
  Synthetic nucleic acid sequence
ctcaactggtgtcgtggagtcggcaattcagttgagagactcaa

SEQ ID NO: 725 - DNA, 44 bp, Artificial sequence
  Synthetic nucleic acid sequence
ctcaactggtgtcgtggagtcggcaattcagttgagacatgcac

SEQ ID NO: 726 - DNA, 44 bp, Artificial sequence
  Synthetic nucleic acid sequence
ctcaactggtgtcgtggagtcggcaattcagttgagtatgggta

SEQ ID NO: 727 - DNA, 44 bp, Artificial sequence
  Synthetic nucleic acid sequence
ctcaactggtgtcgtggagtcggcaattcagttgagacatgttc

SEQ ID NO: 728 - DNA, 44 bp, Artificial sequence
  Synthetic nucleic acid sequence
ctcaactggtgtcgtggagtcggcaattcagttgagacatgtac

SEQ ID NO: 729 - DNA, 44 bp, Artificial sequence
  Synthetic nucleic acid sequence
ctcaactggtgtcgtggagtcggcaattcagttgaggggaagaa

SEQ ID NO: 730 - DNA, 44 bp, Artificial sequence; identical to SEQ ID NO: 360
  Synthetic nucleic acid sequence

SEQ ID NO: 731 - DNA, 44 bp, Artificial sequence
  Synthetic nucleic acid sequence
ctcaactggtgtcgtggagtcggcaattcagttgaggaagagag

SEQ ID NO: 732 - DNA, 44 bp, Artificial sequence; identical to SEQ ID NO: 124
  Synthetic nucleic acid sequence

SEQ ID NO: 733 - DNA, 44 bp, Artificial sequence; identical to SEQ ID NO: 325
  Synthetic nucleic acid sequence

SEQ ID NO: 734 - DNA, 44 bp, Artificial sequence
  Synthetic nucleic acid sequence
ctcaactggtgtcgtggagtcggcaattcagttgagcagctatg

SEQ ID NO: 735 - DNA, 44 bp, Artificial sequence
  Synthetic nucleic acid sequence
ctcaactggtgtcgtggagtcggcaattcagttgagtccaaaac

SEQ ID NO: 736 - DNA, 44 bp, Artificial sequence
  Synthetic nucleic acid sequence
ctcaactggtgtcgtggagtcggcaattcagttgagagcagcac

SEQ ID NO: 737 - DNA, 44 bp, Artificial sequence
  Synthetic nucleic acid sequence
ctcaactggtgtcgtggagtcggcaattcagttgagttgatagg

SEQ ID NO: 738 - DNA, 44 bp, Artificial sequence
  Synthetic nucleic acid sequence
ctcaactggtgtcgtggagtcggcaattcagttgagactggagg

SEQ ID NO: 739 - DNA, 44 bp, Artificial sequence
  Synthetic nucleic acid sequence
ctcaactggtgtcgtggagtcggcaattcagttgagatcctcat

SEQ ID NO: 740 - DNA, 44 bp, Artificial sequence
  Synthetic nucleic acid sequence
ctcaactggtgtcgtggagtcggcaattcagttgagaaaaaggt

SEQ ID NO: 741 - DNA, 44 bp, Artificial sequence
  Synthetic nucleic acid sequence
ctcaactggtgtcgtggagtcggcaattcagttgagggtcagga

SEQ ID NO: 742 - DNA, 44 bp, Artificial sequence
  Synthetic nucleic acid sequence
ctcaactggtgtcgtggagtcggcaattcagttgagaggcatca

SEQ ID NO: 743 - DNA, 44 bp, Artificial sequence; identical to SEQ ID NO: 377
  Synthetic nucleic acid sequence

SEQ ID NO: 744 - DNA, 44 bp, Artificial sequence; identical to SEQ ID NO: 378
  Synthetic nucleic acid sequence

SEQ ID NO: 745 - DNA, 44 bp, Artificial sequence
  Synthetic nucleic acid sequence
ctcaactggtgtcgtggagtcggcaattcagttgaggctataaa

SEQ ID NO: 746 - DNA, 44 bp, Artificial sequence
  Synthetic nucleic acid sequence
ctcaactggtgtcgtggagtcggcaattcagttgagaccgaccg

SEQ ID NO: 747 - DNA, 44 bp, Artificial sequence
  Synthetic nucleic acid sequence
ctcaactggtgtcgtggagtcggcaattcagttgagctcaatca

SEQ ID NO: 748 - DNA, 44 bp, Artificial sequence
  Synthetic nucleic acid sequence
ctcaactggtgtcgtggagtcggcaattcagttgagtctgggca

SEQ ID NO: 749 - DNA, 44 bp, Artificial sequence
  Synthetic nucleic acid sequence
ctcaactggtgtcgtggagtcggcaattcagttgagacagtcag

SEQ ID NO: 750 - DNA, 44 bp, Artificial sequence
  Synthetic nucleic acid sequence
ctcaactggtgtcgtggagtcggcaattcagttgaggtctccag

SEQ ID NO: 751 - DNA, 44 bp, Artificial sequence
  Synthetic nucleic acid sequence
ctcaactggtgtcgtggagtcggcaattcagttgagaagcactg

SEQ ID NO: 752 - DNA, 44 bp, Artificial sequence; identical to SEQ ID NO: 382
  Synthetic nucleic acid sequence

SEQ ID NO: 753 - DNA, 44 bp, Artificial sequence
  Synthetic nucleic acid sequence
ctcaactggtgtcgtggagtcggcaattcagttgaggatggcag

SEQ ID NO: 754 - DNA, 44 bp, Artificial sequence
  Synthetic nucleic acid sequence
ctcaactggtgtcgtggagtcggcaattcagttgagacaatcag

SEQ ID NO: 755 - DNA, 44 bp, Artificial sequence
  Synthetic nucleic acid sequence
ctcaactggtgtcgtggagtcggcaattcagttgaggaaagtgt

SEQ ID NO: 756 - DNA, 44 bp, Artificial sequence
  Synthetic nucleic acid sequence
ctcaactggtgtcgtggagtcggcaattcagttgagcaggctca

SEQ ID NO: 757 - DNA, 44 bp, Artificial sequence; identical to SEQ ID NO: 386
  Synthetic nucleic acid sequence

SEQ ID NO: 758 - DNA, 44 bp, Artificial sequence
  Synthetic nucleic acid sequence
ctcaactggtgtcgtggagtcggcaattcagttgagattcacac

SEQ ID NO: 759 - DNA, 44 bp, Artificial sequence; identical to SEQ ID NO: 393
  Synthetic nucleic acid sequence

SEQ ID NO: 760 - DNA, 44 bp, Artificial sequence; identical to SEQ ID NO: 182
  Synthetic nucleic acid sequence

SEQ ID NO: 761 - DNA, 44 bp, Artificial sequence
  Synthetic nucleic acid sequence
ctcaactggtgtcgtggagtcggcaattcagttgagacgtgaaa

SEQ ID NO: 762 - DNA, 44 bp, Artificial sequence; identical to SEQ ID NO: 396
  Synthetic nucleic acid sequence

SEQ ID NO: 763 - DNA, 44 bp, Artificial sequence
  Synthetic nucleic acid sequence
ctcaactggtgtcgtggagtcggcaattcagttgagcgcatgtt

SEQ ID NO: 764 - DNA, 44 bp, Artificial sequence
  Synthetic nucleic acid sequence
ctcaactggtgtcgtggagtcggcaattcagttgagagccacag

SEQ ID NO: 765 - DNA, 44 bp, Artificial sequence
  Synthetic nucleic acid sequence
ctcaactggtgtcgtggagtcggcaattcagttgagattgtgaa

SEQ ID NO: 766 - DNA, 44 bp, Artificial sequence
  Synthetic nucleic acid sequence
ctcaactggtgtcgtggagtcggcaattcagttgagacattgcc

SEQ ID NO: 767 - DNA, 44 bp, Artificial sequence
  Synthetic nucleic acid sequence
ctcaactggtgtcgtggagtcggcaattcagttgagcggctagt

SEQ ID NO: 768 - DNA, 44 bp, Artificial sequence
  Synthetic nucleic acid sequence
ctcaactggtgtcgtggagtcggcaattcagttgagacggcatt

SEQ ID NO: 769 - DNA, 44 bp, Artificial sequence
  Synthetic nucleic acid sequence
ctcaactggtgtcgtggagtcggcaattcagttgagaggagtcg

SEQ ID NO: 770 - DNA, 44 bp, Artificial sequence
  Synthetic nucleic acid sequence
ctcaactggtgtcgtggagtcggcaattcagttgagtggttcaa

SEQ ID NO: 771 - DNA, 44 bp, Artificial sequence; identical to SEQ ID NO: 404
  Synthetic nucleic acid sequence

SEQ ID NO: 772 - DNA, 44 bp, Artificial sequence
  Synthetic nucleic acid sequence
ctcaactggtgtcgtggagtcggcaattcagttgagccagctag

SEQ ID NO: 773 - DNA, 44 bp, Artificial sequence
  Synthetic nucleic acid sequence
ctcaactggtgtcgtggagtcggcaattcagttgagatgaatgc

SEQ ID NO: 774 - DNA, 44 bp, Artificial sequence
  Synthetic nucleic acid sequence
ctcaactggtgtcgtggagtcggcaattcagttgagatgcatgc

SEQ ID NO: 775 - DNA, 44 bp, Artificial sequence; identical to SEQ ID NO: 406
  Synthetic nucleic acid sequence

SEQ ID NO: 776 - DNA, 44 bp, Artificial sequence
  Synthetic nucleic acid sequence
ctcaactggtgtcgtggagtcggcaattcagttgaggtctcagt

SEQ ID NO: 777 - DNA, 44 bp, Artificial sequence
  Synthetic nucleic acid sequence
ctcaactggtgtcgtggagtcggcaattcagttgagtgcaagct

SEQ ID NO: 778 - DNA, 44 bp, Artificial sequence; identical to SEQ ID NO: 410
  Synthetic nucleic acid sequence

SEQ ID NO: 779 - DNA, 44 bp, Artificial sequence
  Synthetic nucleic acid sequence
ctcaactggtgtcgtggagtcggcaattcagttgagctacctta

SEQ ID NO: 780 - DNA, 44 bp, Artificial sequence
  Synthetic nucleic acid sequence
ctcaactggtgtcgtggagtcggcaattcagttgagtatctcac

SEQ ID NO: 781 - DNA, 44 bp, Artificial sequence
  Synthetic nucleic acid sequence
ctcaactggtgtcgtggagtcggcaattcagttgagtctactta

SEQ ID NO: 782 - DNA, 44 bp, Artificial sequence
  Synthetic nucleic acid sequence
ctcaactggtgtcgtggagtcggcaattcagttgagtcacatca

SEQ ID NO: 783 - DNA, 44 bp, Artificial sequence; identical to SEQ ID NO: 781
  Synthetic nucleic acid sequence

SEQ ID NO: 784 - DNA, 44 bp, Artificial sequence
  Synthetic nucleic acid sequence
ctcaactggtgtcgtggagtcggcaattcagttgagcagatcag

SEQ ID NO: 785 - DNA, 44 bp, Artificial sequence; identical to SEQ ID NO: 781
  Synthetic nucleic acid sequence

SEQ ID NO: 786 - DNA, 44 bp, Artificial sequence; identical to SEQ ID NO: 784
  Synthetic nucleic acid sequence

SEQ ID NO: 787 - DNA, 44 bp, Artificial sequence
  Synthetic nucleic acid sequence
ctcaactggtgtcgtggagtcggcaattcagttgagtcttatgt

SEQ ID NO: 788 - DNA, 44 bp, Artificial sequence
  Synthetic nucleic acid sequence
ctcaactggtgtcgtggagtcggcaattcagttgagtatgtaca

SEQ ID NO: 789 - DNA, 44 bp, Artificial sequence; identical to SEQ ID NO: 787
  Synthetic nucleic acid sequence

SEQ ID NO: 790 - DNA, 44 bp, Artificial sequence; identical to SEQ ID NO: 787
  Synthetic nucleic acid sequence

SEQ ID NO: 791 - DNA, 44 bp, Artificial sequence
  Synthetic nucleic acid sequence
ctcaactggtgtcgtggagtcggcaattcagttgagcatgtaca

SEQ ID NO: 792 - DNA, 44 bp, Artificial sequence; identical to SEQ ID NO: 787
  Synthetic nucleic acid sequence

SEQ ID NO: 793 - DNA, 44 bp, Artificial sequence; identical to SEQ ID NO: 788
  Synthetic nucleic acid sequence

SEQ ID NO: 794 - DNA, 44 bp, Artificial sequence
  Synthetic nucleic acid sequence
ctcaactggtgtcgtggagtcggcaattcagttgagctatgtgt

SEQ ID NO: 795 - DNA, 44 bp, Artificial sequence; identical to SEQ ID NO: 791
  Synthetic nucleic acid sequence

SEQ ID NO: 796 - DNA, 44 bp, Artificial sequence; identical to SEQ ID NO: 787
  Synthetic nucleic acid sequence

SEQ ID NO: 797 - DNA, 44 bp, Artificial sequence; identical to SEQ ID NO: 788
  Synthetic nucleic acid sequence

SEQ ID NO: 798 - DNA, 44 bp, Artificial sequence; identical to SEQ ID NO: 725
  Synthetic nucleic acid sequence

SEQ ID NO: 799 - DNA, 44 bp, Artificial sequence; identical to SEQ ID NO: 196
  Synthetic nucleic acid sequence

SEQ ID NO: 800 - DNA, 44 bp, Artificial sequence; identical to SEQ ID NO: 358
  Synthetic nucleic acid sequence

SEQ ID NO: 801 - DNA, 44 bp, Artificial sequence
  Synthetic nucleic acid sequence
ctcaactggtgtcgtggagtcggcaattcagttgagtgtgtgtg

SEQ ID NO: 802 - DNA, 44 bp, Artificial sequence
  Synthetic nucleic acid sequence
ctcaactggtgtcgtggagtcggcaattcagttgagtacacaca

SEQ ID NO: 803 - DNA, 44 bp, Artificial sequence
  Synthetic nucleic acid sequence
ctcaactggtgtcgtggagtcggcaattcagttgagtagtgtgt

SEQ ID NO: 804 - DNA, 44 bp, Artificial sequence; identical to SEQ ID NO: 682
  Synthetic nucleic acid sequence

SEQ ID NO: 805 - DNA, 44 bp, Artificial sequence
  Synthetic nucleic acid sequence
ctcaactggtgtcgtggagtcggcaattcagttgagtcacatgt

SEQ ID NO: 806 - DNA, 44 bp, Artificial sequence
  Synthetic nucleic acid sequence
ctcaactggtgtcgtggagtcggcaattcagttgagaatatgtg

SEQ ID NO: 807 - DNA, 44 bp, Artificial sequence
  Synthetic nucleic acid sequence
ctcaactggtgtcgtggagtcggcaattcagttgagcgcatata

SEQ ID NO: 808 - DNA, 44 bp, Artificial sequence
  Synthetic nucleic acid sequence
ctcaactggtgtcgtggagtcggcaattcagttgagcatataca

SEQ ID NO: 809 - DNA, 44 bp, Artificial sequence
  Synthetic nucleic acid sequence
ctcaactggtgtcgtggagtcggcaattcagttgagcacatata

SEQ ID NO: 810 - DNA, 44 bp, Artificial sequence; identical to SEQ ID NO: 807
  Synthetic nucleic acid sequence

SEQ ID NO: 811 - DNA, 44 bp, Artificial sequence
  Synthetic nucleic acid sequence
ctcaactggtgtcgtggagtcggcaattcagttgagacatatac

SEQ ID NO: 812 - DNA, 44 bp, Artificial sequence
  Synthetic nucleic acid sequence
ctcaactggtgtcgtggagtcggcaattcagttgagtgtaggtg

SEQ ID NO: 813 - DNA, 44 bp, Artificial sequence
  Synthetic nucleic acid sequence
ctcaactggtgtcgtggagtcggcaattcagttgagatatatgt

SEQ ID NO: 814 - DNA, 44 bp, Artificial sequence; identical to SEQ ID NO: 811
  Synthetic nucleic acid sequence

SEQ ID NO: 815 - DNA, 44 bp, Artificial sequence
  Synthetic nucleic acid sequence
ctcaactggtgtcgtggagtcggcaattcagttgagcagacaca

SEQ ID NO: 816 - DNA, 44 bp, Artificial sequence
  Synthetic nucleic acid sequence
ctcaactggtgtcgtggagtcggcaattcagttgagggacacca

SEQ ID NO: 817 - DNA, 44 bp, Artificial sequence
  Synthetic nucleic acid sequence
ctcaactggtgtcgtggagtcggcaattcagttgagactcacca

SEQ ID NO: 818 - DNA, 44 bp, Artificial sequence
  Synthetic nucleic acid sequence
ctcaactggtgtcgtggagtcggcaattcagttgaggtgaaaag

SEQ ID NO: 819 - DNA, 44 bp, Artificial sequence; identical to SEQ ID NO: 413
  Synthetic nucleic acid sequence

SEQ ID NO: 820 - DNA, 44 bp, Artificial sequence; identical to SEQ ID NO: 417
  Synthetic nucleic acid sequence

SEQ ID NO: 821 - DNA, 44 bp, Artificial sequence
  Synthetic nucleic acid sequence
ctcaactggtgtcgtggagtcggcaattcagttgaggctgccat

SEQ ID NO: 822 - DNA, 44 bp, Artificial sequence; identical to SEQ ID NO: 422
  Synthetic nucleic acid sequence

SEQ ID NO: 823 - DNA, 44 bp, Artificial sequence
  Synthetic nucleic acid sequence
ctcaactggtgtcgtggagtcggcaattcagttgagtacaaacc

SEQ ID NO: 824 - DNA, 44 bp, Artificial sequence
  Synthetic nucleic acid sequence
ctcaactggtgtcgtggagtcggcaattcagttgagtgaaccct

SEQ ID NO: 825 - DNA, 44 bp, Artificial sequence
  Synthetic nucleic acid sequence
ctcaactggtgtcgtggagtcggcaattcagttgagcaaatcct

SEQ ID NO: 826 - DNA, 44 bp, Artificial sequence
  Synthetic nucleic acid sequence
ctcaactggtgtcgtggagtcggcaattcagttgagtttcaccc

SEQ ID NO: 827 - DNA, 44 bp, Artificial sequence
  Synthetic nucleic acid sequence
ctcaactggtgtcgtggagtcggcaattcagttgagctgcagta

SEQ ID NO: 828 - DNA, 44 bp, Artificial sequence
  Synthetic nucleic acid sequence
ctcaactggtgtcgtggagtcggcaattcagttgagagaaaacc

SEQ ID NO: 829 - DNA, 44 bp, Artificial sequence
  Synthetic nucleic acid sequence
ctcaactggtgtcgtggagtcggcaattcagttgagccattaca

SEQ ID NO: 830 - DNA, 44 bp, Artificial sequence
  Synthetic nucleic acid sequence
ctcaactggtgtcgtggagtcggcaattcagttgagatgattgc

SEQ ID NO: 831 - DNA, 44 bp, Artificial sequence
  Synthetic nucleic acid sequence
ctcaactggtgtcgtggagtcggcaattcagttgagtgagtgca

SEQ ID NO: 832 - DNA, 44 bp, Artificial sequence
  Synthetic nucleic acid sequence
ctcaactggtgtcgtggagtcggcaattcagttgagccaggatc

SEQ ID NO: 833 - DNA, 44 bp, Artificial sequence
  Synthetic nucleic acid sequence
ctcaactggtgtcgtggagtcggcaattcagttgagacagagtc

SEQ ID NO: 834 - DNA, 44 bp, Artificial sequence
  Synthetic nucleic acid sequence
ctcaactggtgtcgtggagtcggcaattcagttgagagtgtgac

SEQ ID NO: 835 - DNA, 44 bp, Artificial sequence
  Synthetic nucleic acid sequence
ctcaactggtgtcgtggagtcggcaattcagttgagtcgtgaca

SEQ ID NO: 836 - DNA, 44 bp, Artificial sequence
  Synthetic nucleic acid sequence
ctcaactggtgtcgtggagtcggcaattcagttgaggagcttgc

SEQ ID NO: 837 - DNA, 44 bp, Artificial sequence
  Synthetic nucleic acid sequence
ctcaactggtgtcgtggagtcggcaattcagttgaggactccgt

SEQ ID NO: 838 - DNA, 44 bp, Artificial sequence; identical to SEQ ID NO: 537
  Synthetic nucleic acid sequence

SEQ ID NO: 839 - DNA, 44 bp, Artificial sequence
  Synthetic nucleic acid sequence
ctcaactggtgtcgtggagtcggcaattcagttgagttgggttc

SEQ ID NO: 840 - DNA, 44 bp, Artificial sequence; identical to SEQ ID NO: 549
  Synthetic nucleic acid sequence

SEQ ID NO: 841 - DNA, 44 bp, Artificial sequence; identical to SEQ ID NO: 558
  Synthetic nucleic acid sequence

SEQ ID NO: 842 - DNA, 44 bp, Artificial sequence
  Synthetic nucleic acid sequence
ctcaactggtgtcgtggagtcggcaattcagttgagtaacgatg

SEQ ID NO: 843 - DNA, 44 bp, Artificial sequence
  Synthetic nucleic acid sequence
ctcaactggtgtcgtggagtcggcaattcagttgagacacatgt

SEQ ID NO: 844 - DNA, 44 bp, Artificial sequence
  Synthetic nucleic acid sequence
ctcaactggtgtcgtggagtcggcaattcagttgagagggacct

SEQ ID NO: 845 - DNA, 44 bp, Artificial sequence
  Synthetic nucleic acid sequence
ctcaactggtgtcgtggagtcggcaattcagttgagagcaggcg

SEQ ID NO: 846 - DNA, 44 bp, Artificial sequence
  Synthetic nucleic acid sequence
ctcaactggtgtcgtggagtcggcaattcagttgagggctctca

SEQ ID NO: 847 - DNA, 44 bp, Artificial sequence
  Synthetic nucleic acid sequence
ctcaactggtgtcgtggagtcggcaattcagttgagcttgggct

SEQ ID NO: 848 - DNA, 44 bp, Artificial sequence
  Synthetic nucleic acid sequence
ctcaactggtgtcgtggagtcggcaattcagttgagggtagtgg

SEQ ID NO: 849 - DNA, 44 bp, Artificial sequence
  Synthetic nucleic acid sequence
ctcaactggtgtcgtggagtcggcaattcagttgagacatgaac

SEQ ID NO: 850 - DNA, 44 bp, Artificial sequence; identical to SEQ ID NO: 725
  Synthetic nucleic acid sequence

SEQ ID NO: 851 - DNA, 44 bp, Artificial sequence
  Synthetic nucleic acid sequence
ctcaactggtgtcgtggagtcggcaattcagttgagacacacat

SEQ ID NO: 852 - DNA, 44 bp, Artificial sequence; identical to SEQ ID NO: 811
  Synthetic nucleic acid sequence

SEQ ID NO: 853 - DNA, 44 bp, Artificial sequence
  Synthetic nucleic acid sequence
ctcaactggtgtcgtggagtcggcaattcagttgagatgaacat

SEQ ID NO: 854 - DNA, 44 bp, Artificial sequence
  Synthetic nucleic acid sequence
ctcaactggtgtcgtggagtcggcaattcagttgagatacgtgt

SEQ ID NO: 855 - DNA, 44 bp, Artificial sequence
  Synthetic nucleic acid sequence
ctcaactggtgtcgtggagtcggcaattcagttgagatcatgtc

SEQ ID NO: 856 - DNA, 44 bp, Artificial sequence
  Synthetic nucleic acid sequence
ctcaactggtgtcgtggagtcggcaattcagttgagtgtgcatg

SEQ ID NO: 857 - DNA, 44 bp, Artificial sequence
  Synthetic nucleic acid sequence
ctcaactggtgtcgtggagtcggcaattcagttgaggcactcaa

SEQ ID NO: 858 - DNA, 44 bp, Artificial sequence
  Synthetic nucleic acid sequence
ctcaactggtgtcgtggagtcggcaattcagttgaggtatgcat

SEQ ID NO: 859 - DNA, 44 bp, Artificial sequence
  Synthetic nucleic acid sequence
ctcaactggtgtcgtggagtcggcaattcagttgagtgtttgca

SEQ ID NO: 860 - DNA, 44 bp, Artificial sequence
  Synthetic nucleic acid sequence
ctcaactggtgtcgtggagtcggcaattcagttgagttgcatgc

SEQ ID NO: 861 - DNA, 44 bp, Artificial sequence
  Synthetic nucleic acid sequence
ctcaactggtgtcgtggagtcggcaattcagttgagttcaccac

SEQ ID NO: 862 - DNA, 44 bp, Artificial sequence
  Synthetic nucleic acid sequence
ctcaactggtgtcgtggagtcggcaattcagttgagtcacacac

SEQ ID NO: 863 - DNA, 44 bp, Artificial sequence
  Synthetic nucleic acid sequence
ctcaactggtgtcgtggagtcggcaattcagttgagggtgcaca

SEQ ID NO: 864 - DNA, 44 bp, Artificial sequence
  Synthetic nucleic acid sequence
ctcaactggtgtcgtggagtcggcaattcagttgagctccaagg

SEQ ID NO: 865 - DNA, 44 bp, Artificial sequence
  Synthetic nucleic acid sequence
ctcaactggtgtcgtggagtcggcaattcagttgagtacaccac

SEQ ID NO: 866 - DNA, 44 bp, Artificial sequence
  Synthetic nucleic acid sequence
ctcaactggtgtcgtggagtcggcaattcagttgagactgagcg

SEQ ID NO: 867 - DNA, 44 bp, Artificial sequence
  Synthetic nucleic acid sequence
ctcaactggtgtcgtggagtcggcaattcagttgagactgtggg

SEQ ID NO: 868 - DNA, 44 bp, Artificial sequence
  Synthetic nucleic acid sequence
ctcaactggtgtcgtggagtcggcaattcagttgagagctcaac

SEQ ID NO: 869 - DNA, 44 bp, Artificial sequence
  Synthetic nucleic acid sequence
ctcaactggtgtcgtggagtcggcaattcagttgagtcagaagc

SEQ ID NO: 870 - DNA, 44 bp, Artificial sequence
  Synthetic nucleic acid sequence
ctcaactggtgtcgtggagtcggcaattcagttgagcctccagt

SEQ ID NO: 871 - DNA, 44 bp, Artificial sequence
  Synthetic nucleic acid sequence
ctcaactggtgtcgtggagtcggcaattcagttgagaccaagag

SEQ ID NO: 872 - DNA, 44 bp, Artificial sequence
  Synthetic nucleic acid sequence
ctcaactggtgtcgtggagtcggcaattcagttgagcccccatg

SEQ ID NO: 873 - DNA, 44 bp, Artificial sequence
  Synthetic nucleic acid sequence
ctcaactggtgtcgtggagtcggcaattcagttgagagctgcct

SEQ ID NO: 874 - DNA, 44 bp, Artificial sequence
  Synthetic nucleic acid sequence
ctcaactggtgtcgtggagtcggcaattcagttgagcagacttc

SEQ ID NO: 875 - DNA, 44 bp, Artificial sequence
  Synthetic nucleic acid sequence
ctcaactggtgtcgtggagtcggcaattcagttgaggaggacac

SEQ ID NO: 876 - DNA, 44 bp, Artificial sequence
  Synthetic nucleic acid sequence
ctcaactggtgtcgtggagtcggcaattcagttgagttgacttg

SEQ ID NO: 877 - DNA, 44 bp, Artificial sequence
  Synthetic nucleic acid sequence
ctcaactggtgtcgtggagtcggcaattcagttgaggtgcctca

SEQ ID NO: 878 - DNA, 44 bp, Artificial sequence
  Synthetic nucleic acid sequence
ctcaactggtgtcgtggagtcggcaattcagttgagtcttcacc

SEQ ID NO: 879 - DNA, 44 bp, Artificial sequence
  Synthetic nucleic acid sequence
ctcaactggtgtcgtggagtcggcaattcagttgagtcattgct

SEQ ID NO: 880 - DNA, 44 bp, Artificial sequence
  Synthetic nucleic acid sequence
ctcaactggtgtcgtggagtcggcaattcagttgaggaataagt

SEQ ID NO: 881 - DNA, 44 bp, Artificial sequence
  Synthetic nucleic acid sequence
ctcaactggtgtcgtggagtcggcaattcagttgagggaccccg

SEQ ID NO: 882 - DNA, 44 bp, Artificial sequence
  Synthetic nucleic acid sequence
ctcaactggtgtcgtggagtcggcaattcagttgagtttggttg

SEQ ID NO: 883 - DNA, 44 bp, Artificial sequence
  Synthetic nucleic acid sequence
ctcaactggtgtcgtggagtcggcaattcagttgagttttctgc

SEQ ID NO: 884 - DNA, 44 bp, Artificial sequence
  Synthetic nucleic acid sequence
ctcaactggtgtcgtggagtcggcaattcagttgaggagtgagg

SEQ ID NO: 885 - DNA, 44 bp, Artificial sequence
  Synthetic nucleic acid sequence
ctcaactggtgtcgtggagtcggcaattcagttgagttacagcc

SEQ ID NO: 886 - DNA, 44 bp, Artificial sequence
  Synthetic nucleic acid sequence
ctcaactggtgtcgtggagtcggcaattcagttgaggaaaactt

SEQ ID NO: 887 - DNA, 44 bp, Artificial sequence
  Synthetic nucleic acid sequence
ctcaactggtgtcgtggagtcggcaattcagttgagcttcaggc

SEQ ID NO: 888 - DNA, 44 bp, Artificial sequence
  Synthetic nucleic acid sequence
ctcaactggtgtcgtggagtcggcaattcagttgagttcagtca

SEQ ID NO: 889 - DNA, 44 bp, Artificial sequence
  Synthetic nucleic acid sequence
ctcaactggtgtcgtggagtcggcaattcagttgagcccacagc

SEQ ID NO: 890 - DNA, 44 bp, Artificial sequence
  Synthetic nucleic acid sequence
ctcaactggtgtcgtggagtcggcaattcagttgagtctccaca

SEQ ID NO: 891 - DNA, 44 bp, Artificial sequence
  Synthetic nucleic acid sequence
ctcaactggtgtcgtggagtcggcaattcagttgagagggaagg

SEQ ID NO: 892 - DNA, 44 bp, Artificial sequence
  Synthetic nucleic acid sequence
ctcaactggtgtcgtggagtcggcaattcagttgagcgagccag

SEQ ID NO: 893 - DNA, 44 bp, Artificial sequence
  Synthetic nucleic acid sequence
ctcaactggtgtcgtggagtcggcaattcagttgagggtggact

SEQ ID NO: 894 - DNA, 44 bp, Artificial sequence
  Synthetic nucleic acid sequence
ctcaactggtgtcgtggagtcggcaattcagttgagtccatcta

SEQ ID NO: 895 - DNA, 44 bp, Artificial sequence
  Synthetic nucleic acid sequence
ctcaactggtgtcgtggagtcggcaattcagttgaggagcgggg

SEQ ID NO: 896 - DNA, 44 bp, Artificial sequence
  Synthetic nucleic acid sequence
ctcaactggtgtcgtggagtcggcaattcagttgagttctttcc

SEQ ID NO: 897 - DNA, 44 bp, Artificial sequence
  Synthetic nucleic acid sequence
ctcaactggtgtcgtggagtcggcaattcagttgagctaggagc

SEQ ID NO: 898 - DNA, 44 bp, Artificial sequence
  Synthetic nucleic acid sequence
ctcaactggtgtcgtggagtcggcaattcagttgagtgcccacc

SEQ ID NO: 899 - DNA, 44 bp, Artificial sequence
  Synthetic nucleic acid sequence
ctcaactggtgtcgtggagtcggcaattcagttgagttttttga

SEQ ID NO: 900 - DNA, 44 bp, Artificial sequence
  Synthetic nucleic acid sequence
ctcaactggtgtcgtggagtcggcaattcagttgagcgtaggca

SEQ ID NO: 901 - DNA, 44 bp, Artificial sequence
  Synthetic nucleic acid sequence
ctcaactggtgtcgtggagtcggcaattcagttgagtcctcctg

SEQ ID NO: 902 - DNA, 44 bp, Artificial sequence
  Synthetic nucleic acid sequence
ctcaactggtgtcgtggagtcggcaattcagttgagctcaactc

SEQ ID NO: 903 - DNA, 44 bp, Artificial sequence
  Synthetic nucleic acid sequence
ctcaactggtgtcgtggagtcggcaattcagttgagcttacatc

SEQ ID NO: 904 - DNA, 44 bp, Artificial sequence
  Synthetic nucleic acid sequence
ctcaactggtgtcgtggagtcggcaattcagttgagggtaccgc

SEQ ID NO: 905 - DNA, 44 bp, Artificial sequence
  Synthetic nucleic acid sequence
ctcaactggtgtcgtggagtcggcaattcagttgaggctgtgtg

SEQ ID NO: 906 - DNA, 44 bp, Artificial sequence
  Synthetic nucleic acid sequence
ctcaactggtgtcgtggagtcggcaattcagttgaggcgaccga

SEQ ID NO: 907 - DNA, 44 bp, Artificial sequence
  Synthetic nucleic acid sequence
ctcaactggtgtcgtggagtcggcaattcagttgagcacgcggg

SEQ ID NO: 908 - DNA, 44 bp, Artificial sequence
  Synthetic nucleic acid sequence
ctcaactggtgtcgtggagtcggcaattcagttgagagagaagg

SEQ ID NO: 909 - DNA, 44 bp, Artificial sequence
  Synthetic nucleic acid sequence
ctcaactggtgtcgtggagtcggcaattcagttgagcgacaccc

SEQ ID NO: 910 - DNA, 44 bp, Artificial sequence
  Synthetic nucleic acid sequence
ctcaactggtgtcgtggagtcggcaattcagttgagaacatttt

SEQ ID NO: 911 - DNA, 44 bp, Artificial sequence; identical to SEQ ID NO: 632
  Synthetic nucleic acid sequence

SEQ ID NO: 912 - DNA, 44 bp, Artificial sequence
  Synthetic nucleic acid sequence
ctcaactggtgtcgtggagtcggcaattcagttgagttccccct

SEQ ID NO: 913 - DNA, 44 bp, Artificial sequence
  Synthetic nucleic acid sequence
ctcaactggtgtcgtggagtcggcaattcagttgagtctacata

SEQ ID NO: 914 - DNA, 44 bp, Artificial sequence
  Synthetic nucleic acid sequence
ctcaactggtgtcgtggagtcggcaattcagttgagtttaccca

SEQ ID NO: 915 - DNA, 44 bp, Artificial sequence; identical to SEQ ID NO: 433
  Synthetic nucleic acid sequence

SEQ ID NO: 916 - DNA, 44 bp, Artificial sequence
  Synthetic nucleic acid sequence
ctcaactggtgtcgtggagtcggcaattcagttgagtctattca

SEQ ID NO: 917 - DNA, 44 bp, Artificial sequence
  Synthetic nucleic acid sequence
ctcaactggtgtcgtggagtcggcaattcagttgagtgatggac

SEQ ID NO: 918 - DNA, 44 bp, Artificial sequence
  Synthetic nucleic acid sequence
ctcaactggtgtcgtggagtcggcaattcagttgagtagtggac

SEQ ID NO: 919 - DNA, 44 bp, Artificial sequence
  Synthetic nucleic acid sequence
ctcaactggtgtcgtggagtcggcaattcagttgaggtcaaaat

SEQ ID NO: 920 - DNA, 44 bp, Artificial sequence
  Synthetic nucleic acid sequence
ctcaactggtgtcgtggagtcggcaattcagttgagtgtgtcag

SEQ ID NO: 921 - DNA, 44 bp, Artificial sequence
  Synthetic nucleic acid sequence
ctcaactggtgtcgtggagtcggcaattcagttgaggctctgtc

SEQ ID NO: 922 - DNA, 44 bp, Artificial sequence
  Synthetic nucleic acid sequence
ctcaactggtgtcgtggagtcggcaattcagttgaggccactgg

SEQ ID NO: 923 - DNA, 44 bp, Artificial sequence
  Synthetic nucleic acid sequence
ctcaactggtgtcgtggagtcggcaattcagttgagacagttgc

SEQ ID NO: 924 - DNA, 44 bp, Artificial sequence
  Synthetic nucleic acid sequence
ctcaactggtgtcgtggagtcggcaattcagttgagaggaggac

SEQ ID NO: 925 - DNA, 44 bp, Artificial sequence
  Synthetic nucleic acid sequence
ctcaactggtgtcgtggagtcggcaattcagttgagccagctcc

SEQ ID NO: 926 - DNA, 44 bp, Artificial sequence
  Synthetic nucleic acid sequence
ctcaactggtgtcgtggagtcggcaattcagttgagcgtggccc

SEQ ID NO: 927 - DNA, 44 bp, Artificial sequence; identical to SEQ ID NO: 211
  Synthetic nucleic acid sequence

SEQ ID NO: 928 - DNA, 44 bp, Artificial sequence
  Synthetic nucleic acid sequence
ctcaactggtgtcgtggagtcggcaattcagttgagaaggatga

SEQ ID NO: 929 - DNA, 44 bp, Artificial sequence
  Synthetic nucleic acid sequence
ctcaactggtgtcgtggagtcggcaattcagttgagtccaggtg

SEQ ID NO: 930 - DNA, 44 bp, Artificial sequence
  Synthetic nucleic acid sequence
ctcaactggtgtcgtggagtcggcaattcagttgagccctatgt

SEQ ID NO: 931 - DNA, 44 bp, Artificial sequence
  Synthetic nucleic acid sequence
ctcaactggtgtcgtggagtcggcaattcagttgagcatgactg

SEQ ID NO: 932 - DNA, 44 bp, Artificial sequence
  Synthetic nucleic acid sequence
ctcaactggtgtcgtggagtcggcaattcagttgagcctgaact

SEQ ID NO: 933 - DNA, 44 bp, Artificial sequence
  Synthetic nucleic acid sequence
ctcaactggtgtcgtggagtcggcaattcagttgagcatagcct

SEQ ID NO: 934 - DNA, 44 bp, Artificial sequence; identical to SEQ ID NO: 645
  Synthetic nucleic acid sequence

SEQ ID NO: 935 - DNA, 44 bp, Artificial sequence
  Synthetic nucleic acid sequence
ctcaactggtgtcgtggagtcggcaattcagttgagtagtgatt

SEQ ID NO: 936 - DNA, 44 bp, Artificial sequence; identical to SEQ ID NO: 658
  Synthetic nucleic acid sequence

SEQ ID NO: 937 - DNA, 44 bp, Artificial sequence
  Synthetic nucleic acid sequence
ctcaactggtgtcgtggagtcggcaattcagttgagtgtcttga

SEQ ID NO: 938 - DNA, 44 bp, Artificial sequence
  Synthetic nucleic acid sequence
ctcaactggtgtcgtggagtcggcaattcagttgagggcttaga

SEQ ID NO: 939 - DNA, 44 bp, Artificial sequence; identical to SEQ ID NO: 433
  Synthetic nucleic acid sequence

SEQ ID NO: 940 - DNA, 44 bp, Artificial sequence; identical to SEQ ID NO: 916
  Synthetic nucleic acid sequence

SEQ ID NO: 941 - DNA, 44 bp, Artificial sequence
  Synthetic nucleic acid sequence
ctcaactggtgtcgtggagtcggcaattcagttgagactaatgc

SEQ ID NO: 942 - DNA, 44 bp, Artificial sequence
  Synthetic nucleic acid sequence
ctcaactggtgtcgtggagtcggcaattcagttgagatactgag

SEQ ID NO: 943 - DNA, 44 bp, Artificial sequence
  Synthetic nucleic acid sequence
ctcaactggtgtcgtggagtcggcaattcagttgaggtaactgc

SEQ ID NO: 944 - DNA, 44 bp, Artificial sequence; identical to SEQ ID NO: 942
  Synthetic nucleic acid sequence

SEQ ID NO: 945 - DNA, 44 bp, Artificial sequence
  Synthetic nucleic acid sequence
ctcaactggtgtcgtggagtcggcaattcagttgagtgactgct

SEQ ID NO: 946 - DNA, 44 bp, Artificial sequence
  Synthetic nucleic acid sequence
ctcaactggtgtcgtggagtcggcaattcagttgagcaggccgg

SEQ ID NO: 947 - DNA, 30 bp, Artificial sequence
  Synthetic nucleic acid sequence
acactccagctgggtgaggtagtaggttgt

SEQ ID NO: 948 - DNA, 30 bp, Artificial sequence; identical to SEQ ID NO: 947
  Synthetic nucleic acid sequence

SEQ ID NO: 949 - DNA, 30 bp, Artificial sequence; identical to SEQ ID NO: 947
  Synthetic nucleic acid sequence

SEQ ID NO: 950 - DNA, 30 bp, Artificial sequence
  Synthetic nucleic acid sequence
acactccagctgggagaggtagtaggttgc

SEQ ID NO: 951 - DNA, 30 bp, Artificial sequence
  Synthetic nucleic acid sequence
acactccagctgggtgaggtaggaggttgt

SEQ ID NO: 952 - DNA, 30 bp, Artificial sequence
  Synthetic nucleic acid sequence
acactccagctgggtgaggtagtagattgt

SEQ ID NO: 953 - DNA, 30 bp, Artificial sequence
  Synthetic nucleic acid sequence
acactccagctgggtgaggtagtagtttgt

SEQ ID NO: 954 - DNA, 30 bp, Artificial sequence; identical to SEQ ID NO: 953
  Synthetic nucleic acid sequence

SEQ ID NO: 955 - DNA, 30 bp, Artificial sequence
  Synthetic nucleic acid sequence
acactccagctgggtggaatgtaaagaagt

SEQ ID NO: 956 - DNA, 30 bp, Artificial sequence
  Synthetic nucleic acid sequence
acactccagctgggaacccgtagatccgaa

SEQ ID NO: 957 - DNA, 29 bp, Artificial sequence
  Synthetic nucleic acid sequence
acactccagctgggtacagtactgtgata

SEQ ID NO: 958 - DNA, 31 bp, Artificial sequence
  Synthetic nucleic acid sequence
acactccagctgggagcagcattgtacaggg

SEQ ID NO: 959 - DNA, 29 bp, Artificial sequence
  Synthetic nucleic acid sequence
acactccagctgggtaaagtgctgacagt

SEQ ID NO: 960 - DNA, 31 bp, Artificial sequence; identical to SEQ ID NO: 958
  Synthetic nucleic acid sequence

SEQ ID NO: 961 - DNA, 31 bp, Artificial sequence
  Synthetic nucleic acid sequence
acactccagctgggtaccctgtagatccgaa

SEQ ID NO: 962 - DNA, 31 bp, Artificial sequence
  Synthetic nucleic acid sequence
acactccagctgggtaccctgtagaaccgaa

SEQ ID NO: 963 - DNA, 29 bp, Artificial sequence
  Synthetic nucleic acid sequence
acactccagctgggtaggacacatggtct

SEQ ID NO: 964 - DNA, 30 bp, Artificial sequence
  Synthetic nucleic acid sequence
acactccagctgggtggagtgtgacaatgg

SEQ ID NO: 965 - DNA, 28 bp, Artificial sequence
  Synthetic nucleic acid sequence
acactccagctgggtaaggcacgcggtg

SEQ ID NO: 966 - DNA, 30 bp, Artificial sequence
  Synthetic nucleic acid sequence
acactccagctgggacaggtgaggttcttg

SEQ ID NO: 967 - DNA, 32 bp, Artificial sequence
  Synthetic nucleic acid sequence
acactccagctgggtccctgagaccctttaac

SEQ ID NO: 968 - DNA, 30 bp, Artificial sequence
  Synthetic nucleic acid sequence
acactccagctgggtccctgagaccctaac

SEQ ID NO: 969 - DNA, 30 bp, Artificial sequence
  Synthetic nucleic acid sequence
acactccagctgggtcgtaccgtgagtaat

SEQ ID NO: 970 - DNA, 30 bp, Artificial sequence
  Synthetic nucleic acid sequence
acactccagctgggtcggatccgtctgagc

SEQ ID NO: 971 - DNA, 29 bp, Artificial sequence
  Synthetic nucleic acid sequence
acactccagctgggtcacagtgaaccggt

SEQ ID NO: 972 - DNA, 30 bp, Artificial sequence
  Synthetic nucleic acid sequence
acactccagctgggaagcccttaccccaaa

SEQ ID NO: 973 - DNA, 29 bp, Artificial sequence
  Synthetic nucleic acid sequence
acactccagctgggctttttgcggtctgg

SEQ ID NO: 974 - DNA, 30 bp, Artificial sequence
  Synthetic nucleic acid sequence
acactccagctgggcagtgcaatgttaaaa

SEQ ID NO: 975 - DNA, 30 bp, Artificial sequence
  Synthetic nucleic acid sequence
acactccagctgggcagtgcaatgatgaaa

SEQ ID NO: 976 - DNA, 30 bp, Artificial sequence
  Synthetic nucleic acid sequence
acactccagctgggtaacagtctacagcca

SEQ ID NO: 977 - DNA, 30 bp, Artificial sequence
  Synthetic nucleic acid sequence
acactccagctgggtttggtccccttcaac

SEQ ID NO: 978 - DNA, 30 bp, Artificial sequence; identical to SEQ ID NO: 977
  Synthetic nucleic acid sequence

SEQ ID NO: 979 - DNA, 30 bp, Artificial sequence
  Synthetic nucleic acid sequence
acactccagctgggtgtgactggttgacca

SEQ ID NO: 980 - DNA, 31 bp, Artificial sequence
  Synthetic nucleic acid sequence
acactccagctgggtatggctttttattcct

SEQ ID NO: 981 - DNA, 31 bp, Artificial sequence
  Synthetic nucleic acid sequence
acactccagctgggtatggcttttcattcct

SEQ ID NO: 982 - DNA, 31 bp, Artificial sequence
  Synthetic nucleic acid sequence
acactccagctgggttattgcttaagaatac

SEQ ID NO: 983 - DNA, 31 bp, Artificial sequence
  Synthetic nucleic acid sequence
acactccagctgggagctggtgttgtgaatc

SEQ ID NO: 984 - DNA, 30 bp, Artificial sequence
  Synthetic nucleic acid sequence
acactccagctgggtctacagtgcacgtgt

SEQ ID NO: 985 - DNA, 30 bp, Artificial sequence
  Synthetic nucleic acid sequence
acactccagctgggcagtggttttacccta

SEQ ID NO: 986 - DNA, 30 bp, Artificial sequence
  Synthetic nucleic acid sequence
acactccagctgggtaacactgtctggtaa

SEQ ID NO: 987 - DNA, 31 bp, Artificial sequence
  Synthetic nucleic acid sequence
acactccagctgggtgtagtgtttcctactt

SEQ ID NO: 988 - DNA, 29 bp, Artificial sequence
  Synthetic nucleic acid sequence
acactccagctgggcataaagtagaaagc

SEQ ID NO: 989 - DNA, 29 bp, Artificial sequence
  Synthetic nucleic acid sequence
acactccagctgggtgagatgaagcactg

SEQ ID NO: 990 - DNA, 28 bp, Artificial sequence
  Synthetic nucleic acid sequence
acactccagctgggtacagtatagatga

SEQ ID NO: 991 - DNA, 31 bp, Artificial sequence
  Synthetic nucleic acid sequence
acactccagctggggtccagttttcccagga

SEQ ID NO: 992 - DNA, 30 bp, Artificial sequence
  Synthetic nucleic acid sequence
acactccagctgggtgagaactgaattcca

SEQ ID NO: 993 - DNA, 30 bp, Artificial sequence; identical to SEQ ID NO: 992
  Synthetic nucleic acid sequence

SEQ ID NO: 994 - DNA, 30 bp, Artificial sequence
  Synthetic nucleic acid sequence
acactccagctggggtgtgcggaaatgctt

SEQ ID NO: 995 - DNA, 30 bp, Artificial sequence
  Synthetic nucleic acid sequence
acactccagctgggtcagtgcactacagaa

SEQ ID NO: 996 - DNA, 30 bp, Artificial sequence
  Synthetic nucleic acid sequence
acactccagctgggtcagtgcatcacagaa

SEQ ID NO: 997 - DNA, 31 bp, Artificial sequence
  Synthetic nucleic acid sequence
acactccagctgggtctggctccgtgtcttc

SEQ ID NO: 998 - DNA, 30 bp, Artificial sequence
  Synthetic nucleic acid sequence
acactccagctgggtctcccaacccttgta

SEQ ID NO: 999 - DNA, 29 bp, Artificial sequence
  Synthetic nucleic acid sequence
acactccagctgggtcgaggagctcacag

SEQ ID NO: 1000 - DNA, 29 bp, Artificial sequence
  Synthetic nucleic acid sequence
acactccagctgggtcagtgcatgacaga

SEQ ID NO: 1001 - DNA, 30 bp, Artificial sequence
  Synthetic nucleic acid sequence
acactccagctgggttgcatagtcacaaaa

SEQ ID NO: 1002 - DNA, 30 bp, Artificial sequence
  Synthetic nucleic acid sequence
acactccagctgggtaggttatccgtgttg

SEQ ID NO: 1003 - DNA, 30 bp, Artificial sequence
  Synthetic nucleic acid sequence
acactccagctgggtagcagcacataatgg

SEQ ID NO: 1004 - DNA, 30 bp, Artificial sequence
  Synthetic nucleic acid sequence
acactccagctgggtagcagcacatcatgg

SEQ ID NO: 1005 - DNA, 30 bp, Artificial sequence
  Synthetic nucleic acid sequence
acactccagctgggtagcagcacgtaaata

SEQ ID NO: 1006 - DNA, 31 bp, Artificial sequence
  Synthetic nucleic acid sequence
acactccagctgggcaaagtgcttacagtgc

SEQ ID NO: 1007 - DNA, 31 bp, Artificial sequence
  Synthetic nucleic acid sequence
acactccagctgggaacattcaacgctgtcg

SEQ ID NO: 1008 - DNA, 31 bp, Artificial sequence
  Synthetic nucleic acid sequence
acactccagctgggaacattcattgctgtcg

SEQ ID NO: 1009 - DNA, 30 bp, Artificial sequence
  Synthetic nucleic acid sequence
acactccagctgggaacattcaacctgtcg

SEQ ID NO: 1010 - DNA, 31 bp, Artificial sequence
  Synthetic nucleic acid sequence
acactccagctgggaacattcattgttgtcg

SEQ ID NO: 1011 - DNA, 30 bp, Artificial sequence
  Synthetic nucleic acid sequence
acactccagctgggtatggcactggtagaa

SEQ ID NO: 1012 - DNA, 30 bp, Artificial sequence
  Synthetic nucleic acid sequence
acactccagctgggtggacggagaactgat

SEQ ID NO: 1013 - DNA, 30 bp, Artificial sequence
  Synthetic nucleic acid sequence
acactccagctgggtggagagaaaggcagt

SEQ ID NO: 1014 - DNA, 30 bp, Artificial sequence
  Synthetic nucleic acid sequence
acactccagctgggcaaagaattctccttt

SEQ ID NO: 1015 - DNA, 30 bp, Artificial sequence
  Synthetic nucleic acid sequence
acactccagctgggtcgtgtcttgtgttgc

SEQ ID NO: 1016 - DNA, 29 bp, Artificial sequence
  Synthetic nucleic acid sequence
acactccagctgggctcccacatgcaggg

SEQ ID NO: 1017 - DNA, 29 bp, Artificial sequence
  Synthetic nucleic acid sequence
acactccagctgggcatcccttgcatggt

SEQ ID NO: 1018 - DNA, 31 bp, Artificial sequence
  Synthetic nucleic acid sequence
acactccagctgggtaaggtgcatctagtgc

SEQ ID NO: 1019 - DNA, 30 bp, Artificial sequence
  Synthetic nucleic acid sequence
acactccagctgggtgatatgtttgatata

SEQ ID NO: 1020 - DNA, 29 bp, Artificial sequence
  Synthetic nucleic acid sequence
acactccagctgggtgatatgtttgatat

SEQ ID NO: 1021 - DNA, 31 bp, Artificial sequence
  Synthetic nucleic acid sequence
acactccagctgggcaacggaatcccaaaag

SEQ ID NO: 1022 - DNA, 29 bp, Artificial sequence
  Synthetic nucleic acid sequence
acactccagctgggctgacctatgaattg

SEQ ID NO: 1023 - DNA, 30 bp, Artificial sequence
  Synthetic nucleic acid sequence
acactccagctgggaactggcctacaaagt

SEQ ID NO: 1024 - DNA, 30 bp, Artificial sequence
  Synthetic nucleic acid sequence
acactccagctgggtgtaacagcaactcca

SEQ ID NO: 1025 - DNA, 29 bp, Artificial sequence
  Synthetic nucleic acid sequence
acactccagctgggtagcagcacagaaat

SEQ ID NO: 1026 - DNA, 30 bp, Artificial sequence
  Synthetic nucleic acid sequence
acactccagctgggtaggtagtttcatgtt

SEQ ID NO: 1027 - DNA, 30 bp, Artificial sequence
  Synthetic nucleic acid sequence
acactccagctgggtaggtagtttcctgtt

SEQ ID NO: 1028 - DNA, 30 bp, Artificial sequence
  Synthetic nucleic acid sequence
acactccagctgggttcaccaccttctcca

SEQ ID NO: 1029 - DNA, 31 bp, Artificial sequence
  Synthetic nucleic acid sequence
acactccagctgggcccagtgttcagactac

SEQ ID NO: 1030 - DNA, 30 bp, Artificial sequence
  Synthetic nucleic acid sequence
acactccagctgggacagtagtctgcacat

SEQ ID NO: 1031 - DNA, 30 bp, Artificial sequence; identical to SEQ ID NO: 1030
  Synthetic nucleic acid sequence

SEQ ID NO: 1032 - DNA, 31 bp, Artificial sequence
  Synthetic nucleic acid sequence
acactccagctgggtgtgcaaatctatgcaa

SEQ ID NO: 1033 - DNA, 31 bp, Artificial sequence
  Synthetic nucleic acid sequence
acactccagctgggtgtgcaaatccatgcaa

SEQ ID NO: 1034 - DNA, 30 bp, Artificial sequence; identical to SEQ ID NO: 986
  Synthetic nucleic acid sequence

SEQ ID NO: 1035 - DNA, 30 bp, Artificial sequence
  Synthetic nucleic acid sequence
acactccagctgggtaatactgcctggtaa

SEQ ID NO: 1036 - DNA, 31 bp, Artificial sequence
  Synthetic nucleic acid sequence
acactccagctgggtaatactgccgggtaat

SEQ ID NO: 1037 - DNA, 30 bp, Artificial sequence
  Synthetic nucleic acid sequence
acactccagctggggtgaaatgtttaggac

SEQ ID NO: 1038 - DNA, 30 bp, Artificial sequence
  Synthetic nucleic acid sequence
acactccagctgggttccctttgtcatcct

SEQ ID NO: 1039 - DNA, 30 bp, Artificial sequence
  Synthetic nucleic acid sequence
acactccagctgggtccttcattccaccgg

SEQ ID NO: 1040 - DNA, 30 bp, Artificial sequence
  Synthetic nucleic acid sequence
acactccagctgggtggaatgtaaggaagt

SEQ ID NO: 1041 - DNA, 30 bp, Artificial sequence
  Synthetic nucleic acid sequence
acactccagctgggataagacgagcaaaaa

SEQ ID NO: 1042 - DNA, 30 bp, Artificial sequence
  Synthetic nucleic acid sequence
acactccagctgggataagacgaacaaaag

SEQ ID NO: 1043 - DNA, 31 bp, Artificial sequence
  Synthetic nucleic acid sequence
acactccagctgggtaaagtgcttatagtgc

SEQ ID NO: 1044 - DNA, 31 bp, Artificial sequence
  Synthetic nucleic acid sequence
acactccagctgggcaaagtgctcatagtgc

SEQ ID NO: 1045 - DNA, 30 bp, Artificial sequence
  Synthetic nucleic acid sequence
acactccagctgggtagcttatcagactga

SEQ ID NO: 1046 - DNA, 30 bp, Artificial sequence
  Synthetic nucleic acid sequence
acactccagctgggctgtgcgtgtgacagc

SEQ ID NO: 1047 - DNA, 30 bp, Artificial sequence
  Synthetic nucleic acid sequence
acactccagctgggacagcaggcacagaca

SEQ ID NO: 1048 - DNA, 30 bp, Artificial sequence
  Synthetic nucleic acid sequence
acactccagctgggtaatctcagctggcaa

SEQ ID NO: 1049 - DNA, 30 bp, Artificial sequence
  Synthetic nucleic acid sequence
acactccagctgggaaatctctgcaggcaa

SEQ ID NO: 1050 - DNA, 29 bp, Artificial sequence
  Synthetic nucleic acid sequence
acactccagctgggttgtgcttgatctaa

SEQ ID NO: 1051 - DNA, 29 bp, Artificial sequence
  Synthetic nucleic acid sequence
acactccagctgggtgattgtccaaacgc

SEQ ID NO: 1052 - DNA, 30 bp, Artificial sequence
  Synthetic nucleic acid sequence
acactccagctgggaagctgccagttgaag

SEQ ID NO: 1053 - DNA, 31 bp, Artificial sequence
  Synthetic nucleic acid sequence
acactccagctgggagctacattgtctgctg

SEQ ID NO: 1054 - DNA, 29 bp, Artificial sequence
  Synthetic nucleic acid sequence
acactccagctgggagctacatctggcta

SEQ ID NO: 1055 - DNA, 30 bp, Artificial sequence
  Synthetic nucleic acid sequence
acactccagctgggtgtcagtttgtcaaat

SEQ ID NO: 1056 - DNA, 29 bp, Artificial sequence
  Synthetic nucleic acid sequence
acactccagctgggatcacattgccaggg

SEQ ID NO: 1057 - DNA, 29 bp, Artificial sequence
  Synthetic nucleic acid sequence
acactccagctgggatcacattgccaggg

SEQ ID NO: 1058 - DNA, 30 bp, Artificial sequence
  Synthetic nucleic acid sequence
acactccagctgggtggctcagttcagcag

SEQ ID NO: 1059 - DNA, 30 bp, Artificial sequence
  Synthetic nucleic acid sequence
acactccagctgggcattgcacttgtctcg

SEQ ID NO: 1060 - DNA, 30 bp, Artificial sequence
  Synthetic nucleic acid sequence
acactccagctgggttcaagtaatccagga

SEQ ID NO: 1061 - DNA, 29 bp, Artificial sequence
  Synthetic nucleic acid sequence
acactccagctgggttcaagtaattcagg

SEQ ID NO: 1062 - DNA, 29 bp, Artificial sequence
  Synthetic nucleic acid sequence
acactccagctgggttcacagtggctaag

SEQ ID NO: 1063 - DNA, 29 bp, Artificial sequence
  Synthetic nucleic acid sequence
acactccagctgggttcacagtggctaag

SEQ ID NO: 1064 - DNA, 30 bp, Artificial sequence
  Synthetic nucleic acid sequence
acactccagctgggaaggagctcacagtct

SEQ ID NO: 1065 - DNA, 30 bp, Artificial sequence
  Synthetic nucleic acid sequence
acactccagctggggagggttgggtggagg

SEQ ID NO: 1066 - DNA, 29 bp, Artificial sequence
  Synthetic nucleic acid sequence
acactccagctgggagggccccccctcaa

SEQ ID NO: 1067 - DNA, 30 bp, Artificial sequence
  Synthetic nucleic acid sequence
acactccagctgggtagcaccatctgaaat

SEQ ID NO: 1068 - DNA, 31 bp, Artificial sequence
  Synthetic nucleic acid sequence
acactccagctgggtagcaccatttgaaatc

SEQ ID NO: 1069 - DNA, 30 bp, Artificial sequence
  Synthetic nucleic acid sequence
acactccagctgggtagcaccatttgaaat

SEQ ID NO: 1070 - DNA, 31 bp, Artificial sequence
  Synthetic nucleic acid sequence
acactccagctgggcagtgcaatagtattgt

SEQ ID NO: 1071 - DNA, 31 bp, Artificial sequence
  Synthetic nucleic acid sequence
acactccagctgggtaagtgcttccatgttt

SEQ ID NO: 1072 - DNA, 31 bp, Artificial sequence; identical to SEQ ID NO: 1071
  Synthetic nucleic acid sequence

SEQ ID NO: 1073 - DNA, 31 bp, Artificial sequence; identical to SEQ ID NO: 1071
  Synthetic nucleic acid sequence

SEQ ID NO: 1074 - DNA, 30 bp, Artificial sequence
  Synthetic nucleic acid sequence
acactccagctgggtgtaaacatcctcgac

SEQ ID NO: 1075 - DNA, 30 bp, Artificial sequence
  Synthetic nucleic acid sequence
acactccagctgggtgtaaacatcctacac

SEQ ID NO: 1076 - DNA, 31 bp, Artificial sequence
  Synthetic nucleic acid sequence
acactccagctgggtgtaaacatcctacact

SEQ ID NO: 1077 - DNA, 30 bp, Artificial sequence
  Synthetic nucleic acid sequence
acactccagctgggtgtaaacatccccgac

SEQ ID NO: 1078 - DNA, 30 bp, Artificial sequence
  Synthetic nucleic acid sequence
acactccagctgggtgtaaacatccttgac

SEQ ID NO: 1079 - DNA, 30 bp, Artificial sequence
  Synthetic nucleic acid sequence
acactccagctgggtattgcacattactaa

SEQ ID NO: 1080 - DNA, 30 bp, Artificial sequence
  Synthetic nucleic acid sequence
acactccagctgggaaaagctgggttgaga

SEQ ID NO: 1081 - DNA, 29 bp, Artificial sequence
  Synthetic nucleic acid sequence
acactccagctgggcacattacacggtcg

SEQ ID NO: 1082 - DNA, 30 bp, Artificial sequence
  Synthetic nucleic acid sequence
acactccagctgggaggtggtccgtggcgc

SEQ ID NO: 1083 - DNA, 31 bp, Artificial sequence
  Synthetic nucleic acid sequence
acactccagctgggcgcatcccctagggcat

SEQ ID NO: 1084 - DNA, 30 bp, Artificial sequence
  Synthetic nucleic acid sequence
acactccagctgggctggccctctctgccc

SEQ ID NO: 1085 - DNA, 29 bp, Artificial sequence
  Synthetic nucleic acid sequence
acactccagctggggtgcattgtagttgc

SEQ ID NO: 1086 - DNA, 30 bp, Artificial sequence
  Synthetic nucleic acid sequence
acactccagctgggtctctgggcctgtgtc

SEQ ID NO: 1087 - DNA, 29 bp, Artificial sequence
  Synthetic nucleic acid sequence
acactccagctggggcccctgggcctatc

SEQ ID NO: 1088 - DNA, 30 bp, Artificial sequence
  Synthetic nucleic acid sequence
acactccagctgggctaggtatggtcccag

SEQ ID NO: 1089 - DNA, 31 bp, Artificial sequence
  Synthetic nucleic acid sequence
acactccagctgggtcaagagcaataacgaa

SEQ ID NO: 1090 - DNA, 30 bp, Artificial sequence
  Synthetic nucleic acid sequence
acactccagctgggtccagcatcagtgatt

SEQ ID NO: 1091 - DNA, 30 bp, Artificial sequence
  Synthetic nucleic acid sequence
acactccagctgggaacaatatcctggtgc

SEQ ID NO: 1092 - DNA, 31 bp, Artificial sequence
  Synthetic nucleic acid sequence
acactccagctgggtccctgtcctccaggag

SEQ ID NO: 1093 - DNA, 30 bp, Artificial sequence
  Synthetic nucleic acid sequence
acactccagctgggttataaagcaatgaga

SEQ ID NO: 1094 - DNA, 31 bp, Artificial sequence
  Synthetic nucleic acid sequence
acactccagctgggtctcacacagaaatcgc

SEQ ID NO: 1095 - DNA, 30 bp, Artificial sequence
  Synthetic nucleic acid sequence
acactccagctgggtggcagtgtcttagct

SEQ ID NO: 1096 - DNA, 31 bp, Artificial sequence
  Synthetic nucleic acid sequence
acactccagctgggaggcagtgtagttagct

SEQ ID NO: 1097 - DNA, 30 bp, Artificial sequence
  Synthetic nucleic acid sequence
acactccagctgggttatcagaatctccag

SEQ ID NO: 1098 - DNA, 30 bp, Artificial sequence
  Synthetic nucleic acid sequence
acactccagctgggaattgcacggtatcca

SEQ ID NO: 1099 - DNA, 30 bp, Artificial sequence
  Synthetic nucleic acid sequence
acactccagctgggtaatgcccctaaaaat

SEQ ID NO: 1100 - DNA, 30 bp, Artificial sequence
  Synthetic nucleic acid sequence
acactccagctgggaattgcactttagcaa

SEQ ID NO: 1101 - DNA, 29 bp, Artificial sequence
  Synthetic nucleic acid sequence
acactccagctgggaataatacatggttg

SEQ ID NO: 1102 - DNA, 30 bp, Artificial sequence
  Synthetic nucleic acid sequence
acactccagctgggagatcgaccgtgttat

SEQ ID NO: 1103 - DNA, 30 bp, Artificial sequence
  Synthetic nucleic acid sequence
acactccagctggggcctgctggggtggaa

SEQ ID NO: 1104 - DNA, 30 bp, Artificial sequence
  Synthetic nucleic acid sequence
acactccagctgggatataatacaacctgc

SEQ ID NO: 1105 - DNA, 30 bp, Artificial sequence
  Synthetic nucleic acid sequence
acactccagctgggtttgttcgttcggctc

SEQ ID NO: 1106 - DNA, 30 bp, Artificial sequence
  Synthetic nucleic acid sequence
acactccagctgggatcacacaaaggcaac

SEQ ID NO: 1107 - DNA, 29 bp, Artificial sequence
  Synthetic nucleic acid sequence
acactccagctgggactggacttggagtc

SEQ ID NO: 1108 - DNA, 29 bp, Artificial sequence
  Synthetic nucleic acid sequence
acactccagctgggtggtagactatggaa

SEQ ID NO: 1109 - DNA, 30 bp, Artificial sequence
  Synthetic nucleic acid sequence
acactccagctgggtatacaagggcaagct

SEQ ID NO: 1110 - DNA, 30 bp, Artificial sequence
  Synthetic nucleic acid sequence
acactccagctggggaagttgttcgtggtg

SEQ ID NO: 1111 - DNA, 30 bp, Artificial sequence
  Synthetic nucleic acid sequence
acactccagctggggaatgttgctcggtga

SEQ ID NO: 1112 - DNA, 31 bp, Artificial sequence
  Synthetic nucleic acid sequence
acactccagctgggaggttacccgagcaact

SEQ ID NO: 1113 - DNA, 29 bp, Artificial sequence
  Synthetic nucleic acid sequence
acactccagctgggaatataacacagatg

SEQ ID NO: 1114 - DNA, 29 bp, Artificial sequence
  Synthetic nucleic acid sequence
acactccagctgggtagtagaccgtatag

SEQ ID NO: 1115 - DNA, 31 bp, Artificial sequence
  Synthetic nucleic acid sequence
acactccagctgggatcaacagacattaatt

SEQ ID NO: 1116 - DNA, 31 bp, Artificial sequence
  Synthetic nucleic acid sequence
acactccagctgggagctcggtctgaggccc

SEQ ID NO: 1117 - DNA, 31 bp, Artificial sequence
  Synthetic nucleic acid sequence
acactccagctgggtgaggggcagagagcga

SEQ ID NO: 1118 - DNA, 31 bp, Artificial sequence
  Synthetic nucleic acid sequence
acactccagctgggaatgacacgatcactcc

SEQ ID NO: 1119 - DNA, 29 bp, Artificial sequence
  Synthetic nucleic acid sequence
acactccagctgggtgtcttgcaggccgt

SEQ ID NO: 1120 - DNA, 30 bp, Artificial sequence
  Synthetic nucleic acid sequence
acactccagctgggatcatgatgggctcct

SEQ ID NO: 1121 - DNA, 30 bp, Artificial sequence
  Synthetic nucleic acid sequence
acactccagctgggttgcatatgtaggatg

SEQ ID NO: 1122 - DNA, 30 bp, Artificial sequence
  Synthetic nucleic acid sequence
acactccagctgggtggcagtgtattgtta

SEQ ID NO: 1123 - DNA, 30 bp, Artificial sequence
  Synthetic nucleic acid sequence
acactccagctgggttttgcgatgtgttcc

SEQ ID NO: 1124 - DNA, 30 bp, Artificial sequence
  Synthetic nucleic acid sequence
acactccagctgggaaaccgttaccattac

SEQ ID NO: 1125 - DNA, 30 bp, Artificial sequence
  Synthetic nucleic acid sequence
acactccagctgggtcaggctcagtcccct

SEQ ID NO: 1126 - DNA, 30 bp, Artificial sequence
  Synthetic nucleic acid sequence
acactccagctgggagaggctggccgtgat

SEQ ID NO: 1127 - DNA, 30 bp, Artificial sequence
  Synthetic nucleic acid sequence
acactccagctgggtcctgtactgagctgc

SEQ ID NO: 1128 - DNA, 30 bp, Artificial sequence
  Synthetic nucleic acid sequence
acactccagctgggaatcgtacagggtcat

SEQ ID NO: 1129 - DNA, 30 bp, Artificial sequence
  Synthetic nucleic acid sequence
acactccagctgggcaacctggaggactcc

SEQ ID NO: 1130 - DNA, 30 bp, Artificial sequence
  Synthetic nucleic acid sequence
acactccagctgggagtggggaacccttcc

SEQ ID NO: 1131 - DNA, 30 bp, Artificial sequence
  Synthetic nucleic acid sequence
acactccagctgggtgaaacatacacggga

SEQ ID NO: 1132 - DNA, 30 bp, Artificial sequence
  Synthetic nucleic acid sequence
acactccagctgggaaacaaacatggtgca

SEQ ID NO: 1133 - DNA, 30 bp, Artificial sequence
  Synthetic nucleic acid sequence
acactccagctgggtgagtattacatggcc

SEQ ID NO: 1134 - DNA, 29 bp, Artificial sequence
  Synthetic nucleic acid sequence
acactccagctgggttaagacttgcagtg

SEQ ID NO: 1135 - DNA, 30 bp, Artificial sequence
  Synthetic nucleic acid sequence
acactccagctgggagaccctggtctgcac

SEQ ID NO: 1136 - DNA, 30 bp, Artificial sequence
  Synthetic nucleic acid sequence
acactccagctgggcctcccacacccaagg

SEQ ID NO: 1137 - DNA, 30 bp, Artificial sequence
  Synthetic nucleic acid sequence
acactccagctgggcatgccttgagtgtag

SEQ ID NO: 1138 - DNA, 30 bp, Artificial sequence
  Synthetic nucleic acid sequence
acactccagctgggggagaaattatccttg

SEQ ID NO: 1139 - DNA, 30 bp, Artificial sequence
  Synthetic nucleic acid sequence
acactccagctgggtgtgacagattgataa

SEQ ID NO: 1140 - DNA, 30 bp, Artificial sequence
  Synthetic nucleic acid sequence
acactccagctgggaaacattcgcggtgca

SEQ ID NO: 1141 - DNA, 29 bp, Artificial sequence
  Synthetic nucleic acid sequence
acactccagctggggcgacccatacttgg

SEQ ID NO: 1142 - DNA, 28 bp, Artificial sequence
  Synthetic nucleic acid sequence
acactccagctgggatgtataaatgtat

SEQ ID NO: 1143 - DNA, 30 bp, Artificial sequence
  Synthetic nucleic acid sequence
acactccagctgggcacgctcatgcacaca

SEQ ID NO: 1144 - DNA, 31 bp, Artificial sequence
  Synthetic nucleic acid sequence
acactccagctgggtgagtgtgtgtgtgtga

SEQ ID NO: 1145 - DNA, 29 bp, Artificial sequence
  Synthetic nucleic acid sequence
acactccagctgggtaattttatgtataa

SEQ ID NO: 1146 - DNA, 30 bp, Artificial sequence
  Synthetic nucleic acid sequence
acactccagctggggagcttattcataaaa

SEQ ID NO: 1147 - DNA, 30 bp, Artificial sequence
  Synthetic nucleic acid sequence
acactccagctgggtccgagcctgggtctc

SEQ ID NO: 1148 - DNA, 30 bp, Artificial sequence
  Synthetic nucleic acid sequence
acactccagctggggggggtccccggtgct

SEQ ID NO: 1149 - DNA, 29 bp, Artificial sequence
  Synthetic nucleic acid sequence
acactccagctgggaatggcgccactagg

SEQ ID NO: 1150 - DNA, 29 bp, Artificial sequence
  Synthetic nucleic acid sequence
acactccagctggggtgttgaaacaatct

SEQ ID NO: 1151 - DNA, 30 bp, Artificial sequence
  Synthetic nucleic acid sequence
acactccagctgggtatgtctgctgaccat

SEQ ID NO: 1152 - DNA, 29 bp, Artificial sequence
  Synthetic nucleic acid sequence
acactccagctgggtccggttctcagggc

SEQ ID NO: 1153 - DNA, 31 bp, Artificial sequence
  Synthetic nucleic acid sequence
acactccagctgggaggaagccctggagggg

SEQ ID NO: 1154 - DNA, 31 bp, Artificial sequence
  Synthetic nucleic acid sequence
acactccagctgggaaggagcttacaatcta

SEQ ID NO: 1155 - DNA, 30 bp, Artificial sequence
  Synthetic nucleic acid sequence
acactccagctgggtgcggggctagggcta

SEQ ID NO: 1156 - DNA, 28 bp, Artificial sequence
  Synthetic nucleic acid sequence
acactccagctgggcggctctgggtctg

SEQ ID NO: 1157 - DNA, 31 bp, Artificial sequence
  Synthetic nucleic acid sequence
acactccagctgggtggaagactagtgattt

SEQ ID NO: 1158 - DNA, 29 bp, Artificial sequence
  Synthetic nucleic acid sequence
acactccagctggggcaggaacttgtgag

SEQ ID NO: 1159 - DNA, 30 bp, Artificial sequence
  Synthetic nucleic acid sequence
acactccagctgggctgccctggcccgagg

SEQ ID NO: 1160 - DNA, 30 bp, Artificial sequence
  Synthetic nucleic acid sequence
acactccagctgggtatacctcagttttat

SEQ ID NO: 1161 - DNA, 28 bp, Artificial sequence
  Synthetic nucleic acid sequence
acactccagctggggtagaggagatggc

SEQ ID NO: 1162 - DNA, 31 bp, Artificial sequence
  Synthetic nucleic acid sequence
acactccagctgggtctttggttatctagct

SEQ ID NO: 1163 - DNA, 30 bp, Artificial sequence
  Synthetic nucleic acid sequence
acactccagctgggtattgcactcgtcccg

SEQ ID NO: 1164 - DNA, 31 bp, Artificial sequence
  Synthetic nucleic acid sequence
acactccagctgggcaaagtgctgttcgtgc

SEQ ID NO: 1165 - DNA, 31 bp, Artificial sequence
  Synthetic nucleic acid sequence
acactccagctgggtttggcactagcacatt

SEQ ID NO: 1166 - DNA, 30 bp, Artificial sequence
  Synthetic nucleic acid sequence
acactccagctgggtgaggtagtaagttgt

SEQ ID NO: 1167 - DNA, 30 bp, Artificial sequence
  Synthetic nucleic acid sequence
acactccagctgggaacccgtagatccgat

SEQ ID NO: 1168 - DNA, 30 bp, Artificial sequence
  Synthetic nucleic acid sequence
acactccagctgggcacccgtagaaccgac

SEQ ID NO: 1169 - DNA, 31 bp, Artificial sequence
  Synthetic nucleic acid sequence
acactccagctgggtcaaatgctcagactcc

SEQ ID NO: 1170 - DNA, 31 bp, Artificial sequence
  Synthetic nucleic acid sequence
acactccagctgggaaaagtgcttacagtgc

SEQ ID NO: 1171 - DNA, 29 bp, Artificial sequence
  Synthetic nucleic acid sequence
acactccagctgggttgctcactgttctt

SEQ ID NO: 1172 - DNA, 29 bp, Artificial sequence
  Synthetic nucleic acid sequence
acactccagctgggaagcattctttcatt

SEQ ID NO: 1173 - DNA, 30 bp, Artificial sequence
  Synthetic nucleic acid sequence
acactccagctgggtttccggctcgcgtgg

SEQ ID NO: 1174 - DNA, 29 bp, Artificial sequence
  Synthetic nucleic acid sequence
acactccagctgggccgtcgccgccaccc

SEQ ID NO: 1175 - DNA, 31 bp, Artificial sequence
  Synthetic nucleic acid sequence
acactccagctggggagggtcttgggaggga

SEQ ID NO: 1176 - DNA, 35 bp, Artificial sequence
  Synthetic nucleic acid sequence
acactccagctgggcactgtaggtgatggtgagag

SEQ ID NO: 1177 - DNA, 31 bp, Artificial sequence
  Synthetic nucleic acid sequence
acactccagctgggcctgcagcgacttgatg

SEQ ID NO: 1178 - DNA, 29 bp, Artificial sequence
  Synthetic nucleic acid sequence
acactccagctgggagaggataccctttg

SEQ ID NO: 1179 - DNA, 30 bp, Artificial sequence
  Synthetic nucleic acid sequence
acactccagctgggctcctgagccattctg

SEQ ID NO: 1180 - DNA, 32 bp, Artificial sequence
  Synthetic nucleic acid sequence
acactccagctgggagcctgattaaacacatg

SEQ ID NO: 1181 - DNA, 29 bp, Artificial sequence
  Synthetic nucleic acid sequence
acactccagctggggtgccagctgcagtg

SEQ ID NO: 1182 - DNA, 29 bp, Artificial sequence
  Synthetic nucleic acid sequence
acactccagctgggcccggagccaggatg

SEQ ID NO: 1183 - DNA, 29 bp, Artificial sequence
  Synthetic nucleic acid sequence
acactccagctgggtcgtggcctggtctc

SEQ ID NO: 1184 - DNA, 28 bp, Artificial sequence
  Synthetic nucleic acid sequence
acactccagctgggtctgcagggtttgc

SEQ ID NO: 1185 - DNA, 29 bp, Artificial sequence
  Synthetic nucleic acid sequence
acactccagctgggtgttcatgtagatgt

SEQ ID NO: 1186 - DNA, 26 bp, Artificial sequence
  Synthetic nucleic acid sequence
acactccagctgggtcagctggccct

SEQ ID NO: 1187 - DNA, 29 bp, Artificial sequence
  Synthetic nucleic acid sequence
acactccagctgggtggcagggaggctgg

SEQ ID NO: 1188 - DNA, 28 bp, Artificial sequence
  Synthetic nucleic acid sequence
acactccagctgggtcactgttcagaca

SEQ ID NO: 1189 - DNA, 29 bp, Artificial sequence
  Synthetic nucleic acid sequence
acactccagctgggccccacctcctctct

SEQ ID NO: 1190 - DNA, 27 bp, Artificial sequence
  Synthetic nucleic acid sequence
acactccagctggggtgaggactcggg

SEQ ID NO: 1191 - DNA, 30 bp, Artificial sequence
  Synthetic nucleic acid sequence
acactccagctgggtgagcccctgtgccgc

SEQ ID NO: 1192 - DNA, 30 bp, Artificial sequence
  Synthetic nucleic acid sequence
acactccagctggggtgggtacggcccagt

SEQ ID NO: 1193 - DNA, 30 bp, Artificial sequence
  Synthetic nucleic acid sequence
acactccagctgggtcaccagccctgtgtt

SEQ ID NO: 1194 - DNA, 28 bp, Artificial sequence
  Synthetic nucleic acid sequence
acactccagctgggcgtgccaccctttt

SEQ ID NO: 1195 - DNA, 28 bp, Artificial sequence
  Synthetic nucleic acid sequence
acactccagctgggtcacacctgcctcg

SEQ ID NO: 1196 - DNA, 31 bp, Artificial sequence
  Synthetic nucleic acid sequence
acactccagctgggctctcaccactgccctc

SEQ ID NO: 1197 - DNA, 28 bp, Artificial sequence
  Synthetic nucleic acid sequence
acactccagctggggtgtctgggcggac

SEQ ID NO: 1198 - DNA, 28 bp, Artificial sequence
  Synthetic nucleic acid sequence
acactccagctgggtgagccctgtcctc

SEQ ID NO: 1199 - DNA, 30 bp, Artificial sequence
  Synthetic nucleic acid sequence
acactccagctgggtcggcctgaccaccca

SEQ ID NO: 1200 - DNA, 30 bp, Artificial sequence
  Synthetic nucleic acid sequence
acactccagctgggcctcttccccttgtct

SEQ ID NO: 1201 - DNA, 29 bp, Artificial sequence
  Synthetic nucleic acid sequence
acactccagctgggtccttctgctccgtc

SEQ ID NO: 1202 - DNA, 28 bp, Artificial sequence
  Synthetic nucleic acid sequence
acactccagctgggcttcctcgtctgtc

SEQ ID NO: 1203 - DNA, 30 bp, Artificial sequence
  Synthetic nucleic acid sequence
acactccagctgggaactggatcaattata

SEQ ID NO: 1204 - DNA, 34 bp, Artificial sequence
  Synthetic nucleic acid sequence
acactccagctgggaagtagttggtttgtatgag

SEQ ID NO: 1205 - DNA, 29 bp, Artificial sequence
  Synthetic nucleic acid sequence
acactccagctgggaagtgatctaaaggc

SEQ ID NO: 1206 - DNA, 27 bp, Artificial sequence
  Synthetic nucleic acid sequence
acactccagctgggaatggatttttgg

SEQ ID NO: 1207 - DNA, 30 bp, Artificial sequence
  Synthetic nucleic acid sequence
acactccagctgggacccgtcccgttcgtc

SEQ ID NO: 1208 - DNA, 35 bp, Artificial sequence
  Synthetic nucleic acid sequence
acactccagctgggaccttcttgtataagcactgt

SEQ ID NO: 1209 - DNA, 30 bp, Artificial sequence
  Synthetic nucleic acid sequence
acactccagctgggacgcccttccccccct

SEQ ID NO: 1210 - DNA, 29 bp, Artificial sequence
  Synthetic nucleic acid sequence
acactccagctgggacggtgctggatgtg

SEQ ID NO: 1211 - DNA, 29 bp, Artificial sequence
  Synthetic nucleic acid sequence
acactccagctgggactctagctgccaaa

SEQ ID NO: 1212 - DNA, 30 bp, Artificial sequence
  Synthetic nucleic acid sequence
acactccagctgggagaaggaaattgaatt

SEQ ID NO: 1213 - DNA, 29 bp, Artificial sequence
  Synthetic nucleic acid sequence
acactccagctgggagagaagaagatcag

SEQ ID NO: 1214 - DNA, 32 bp, Artificial sequence
  Synthetic nucleic acid sequence
acactccagctgggagcctggaagctggagcc

SEQ ID NO: 1215 - DNA, 31 bp, Artificial sequence
  Synthetic nucleic acid sequence
acactccagctgggaggatgagcaaagaaag

SEQ ID NO: 1216 - DNA, 30 bp, Artificial sequence
  Synthetic nucleic acid sequence
acactccagctgggcggatgagcaaagaaa

SEQ ID NO: 1217 - DNA, 30 bp, Artificial sequence
  Synthetic nucleic acid sequence
acactccagctgggaggcattgacttctca

SEQ ID NO: 1218 - DNA, 29 bp, Artificial sequence
  Synthetic nucleic acid sequence
acactccagctgggagtgaatgatgggtt

SEQ ID NO: 1219 - DNA, 29 bp, Artificial sequence
  Synthetic nucleic acid sequence
acactccagctgggagttaggattaggtc

SEQ ID NO: 1220 - DNA, 29 bp, Artificial sequence
  Synthetic nucleic acid sequence
acactccagctgggatatatgatgactta

SEQ ID NO: 1221 - DNA, 26 bp, Artificial sequence
  Synthetic nucleic acid sequence
acactccagctgggatcccacctctg

SEQ ID NO: 1222 - DNA, 27 bp, Artificial sequence
  Synthetic nucleic acid sequence
acactccagctgggatggataaggctt

SEQ ID NO: 1223 - DNA, 30 bp, Artificial sequence
  Synthetic nucleic acid sequence
acactccagctgggatgggtgaatttgtag

SEQ ID NO: 1224 - DNA, 30 bp, Artificial sequence
  Synthetic nucleic acid sequence
acactccagctgggatggtaccctggcata

SEQ ID NO: 1225 - DNA, 31 bp, Artificial sequence
  Synthetic nucleic acid sequence
acactccagctgggcaagtcttatttgagca

SEQ ID NO: 1226 - DNA, 30 bp, Artificial sequence
  Synthetic nucleic acid sequence
acactccagctgggcaggatgtggtcaagt

SEQ ID NO: 1227 - DNA, 31 bp, Artificial sequence
  Synthetic nucleic acid sequence
acactccagctgggcctcagggctgtagaac

SEQ ID NO: 1228 - DNA, 29 bp, Artificial sequence
  Synthetic nucleic acid sequence
acactccagctgggcctgttgaagtgtaa

SEQ ID NO: 1229 - DNA, 26 bp, Artificial sequence
  Synthetic nucleic acid sequence
acactccagctgggcgggcgtggtgg

SEQ ID NO: 1230 - DNA, 30 bp, Artificial sequence
  Synthetic nucleic acid sequence
acactccagctgggctggactgagccgtgc

SEQ ID NO: 1231 - DNA, 31 bp, Artificial sequence
  Synthetic nucleic acid sequence
acactccagctgggctggagatatggaagag

SEQ ID NO: 1232 - DNA, 30 bp, Artificial sequence
  Synthetic nucleic acid sequence
acactccagctgggcttggcacctagcaag

SEQ ID NO: 1233 - DNA, 34 bp, Artificial sequence
  Synthetic nucleic acid sequence
acactccagctggggatgatgatggcagcaaatt

SEQ ID NO: 1234 - DNA, 33 bp, Artificial sequence
  Synthetic nucleic acid sequence
acactccagctggggggcgacaaagcaagactc

SEQ ID NO: 1235 - DNA, 26 bp, Artificial sequence
  Synthetic nucleic acid sequence
acactccagctggggtccctgttcag

SEQ ID NO: 1236 - DNA, 25 bp, Artificial sequence
  Synthetic nucleic acid sequence
acactccagctgggtccctgttcgg

SEQ ID NO: 1237 - DNA, 25 bp, Artificial sequence
  Synthetic nucleic acid sequence
acactccagctggggtgggggagag

SEQ ID NO: 1238 - DNA, 30 bp, Artificial sequence
  Synthetic nucleic acid sequence
acactccagctgggctgaagctcagagggc

SEQ ID NO: 1239 - DNA, 28 bp, Artificial sequence
  Synthetic nucleic acid sequence
acactccagctgggtaaagagccctgtg

SEQ ID NO: 1240 - DNA, 30 bp, Artificial sequence
  Synthetic nucleic acid sequence
acactccagctgggtacgtagatatatatg

SEQ ID NO: 1241 - DNA, 30 bp, Artificial sequence
  Synthetic nucleic acid sequence
acactccagctgggtagtactgtgcatatc

SEQ ID NO: 1242 - DNA, 25 bp, Artificial sequence
  Synthetic nucleic acid sequence
acactccagctgggtcatattgctt

SEQ ID NO: 1243 - DNA, 25 bp, Artificial sequence
  Synthetic nucleic acid sequence
acactccagctgggtcccaccgctg

SEQ ID NO: 1244 - DNA, 25 bp, Artificial sequence
  Synthetic nucleic acid sequence
acactccagctgggtcgcctcctcc

SEQ ID NO: 1245 - DNA, 28 bp, Artificial sequence
  Synthetic nucleic acid sequence
acactccagctgggtcgtttgccttttt

SEQ ID NO: 1246 - DNA, 30 bp, Artificial sequence
  Synthetic nucleic acid sequence
acactccagctgggtctacaaaggaaagcg

SEQ ID NO: 1247 - DNA, 30 bp, Artificial sequence
  Synthetic nucleic acid sequence
acactccagctgggtctatacagaccctgg

SEQ ID NO: 1248 - DNA, 30 bp, Artificial sequence
  Synthetic nucleic acid sequence
acactccagctgggtctgggcaacaaagtg

SEQ ID NO: 1249 - DNA, 29 bp, Artificial sequence
  Synthetic nucleic acid sequence
acactccagctgggtgcaggaccaagatg

SEQ ID NO: 1250 - DNA, 30 bp, Artificial sequence
  Synthetic nucleic acid sequence
acactccagctgggtgctggatcagtggtt

SEQ ID NO: 1251 - DNA, 29 bp, Artificial sequence
  Synthetic nucleic acid sequence
acactccagctgggtggactgccctgatc

SEQ ID NO: 1252 - DNA, 31 bp, Artificial sequence
  Synthetic nucleic acid sequence
acactccagctgggtggagtccaggaatctg

SEQ ID NO: 1253 - DNA, 27 bp, Artificial sequence
  Synthetic nucleic acid sequence
acactccagctgggtggatttttggat

SEQ ID NO: 1254 - DNA, 32 bp, Artificial sequence
  Synthetic nucleic acid sequence
acactccagctgggtggccctgactgaagacc

SEQ ID NO: 1255 - DNA, 33 bp, Artificial sequence
  Synthetic nucleic acid sequence
acactccagctgggtgggaacgggttccggcag

SEQ ID NO: 1256 - DNA, 30 bp, Artificial sequence
  Synthetic nucleic acid sequence
acactccagctgggtgggtggtctggagat

SEQ ID NO: 1257 - DNA, 30 bp, Artificial sequence
  Synthetic nucleic acid sequence
acactccagctgggtgtgaggttggcattg

SEQ ID NO: 1258 - DNA, 29 bp, Artificial sequence
  Synthetic nucleic acid sequence
acactccagctgggttaggccgcagatct

SEQ ID NO: 1259 - DNA, 30 bp, Artificial sequence
  Synthetic nucleic acid sequence
acactccagctgggttagggccctggctcc

SEQ ID NO: 1260 - DNA, 25 bp, Artificial sequence
  Synthetic nucleic acid sequence
acactccagctgggttcaagtaatt

SEQ ID NO: 1261 - DNA, 30 bp, Artificial sequence
  Synthetic nucleic acid sequence
acactccagctgggttcattcggctgtcca

SEQ ID NO: 1262 - DNA, 30 bp, Artificial sequence
  Synthetic nucleic acid sequence
acactccagctgggttctggaattctgtgt

SEQ ID NO: 1263 - DNA, 26 bp, Artificial sequence
  Synthetic nucleic acid sequence
acactccagctgggttgagaaggagg

SEQ ID NO: 1264 - DNA, 32 bp, Artificial sequence
  Synthetic nucleic acid sequence
acactccagctgggttgcagctgcctgggagt

SEQ ID NO: 1265 - DNA, 29 bp, Artificial sequence
  Synthetic nucleic acid sequence
acactccagctgggttgggacatacttat

SEQ ID NO: 1266 - DNA, 30 bp, Artificial sequence
  Synthetic nucleic acid sequence
acactccagctgggtttagagacggggtct

SEQ ID NO: 1267 - DNA, 30 bp, Artificial sequence
  Synthetic nucleic acid sequence
acactccagctgggtttgaggctacagtga

SEQ ID NO: 1268 - DNA, 30 bp, Artificial sequence
  Synthetic nucleic acid sequence
acactccagctgggttttcaactctaatgg

SEQ ID NO: 1269 - DNA, 26 bp, Artificial sequence
  Synthetic nucleic acid sequence
acactccagctgggacgttggctctg

SEQ ID NO: 1270 - DNA, 30 bp, Artificial sequence
  Synthetic nucleic acid sequence
acactccagctgggactcggcgtggcgtcg

SEQ ID NO: 1271 - DNA, 26 bp, Artificial sequence
  Synthetic nucleic acid sequence
acactccagctggggcatgggtggtt

SEQ ID NO: 1272 - DNA, 26 bp, Artificial sequence
  Synthetic nucleic acid sequence
acactccagctgggcagggaggtgaa

SEQ ID NO: 1273 - DNA, 27 bp, Artificial sequence
  Synthetic nucleic acid sequence
acactccagctggggatgatgctgctg

SEQ ID NO: 1274 - DNA, 30 bp, Artificial sequence
  Synthetic nucleic acid sequence
acactccagctgggtcaaaactgaggggca

SEQ ID NO: 1275 - DNA, 32 bp, Artificial sequence
  Synthetic nucleic acid sequence
acactccagctgggccagacagaattctatgc

SEQ ID NO: 1276 - DNA, 31 bp, Artificial sequence
  Synthetic nucleic acid sequence
acactccagctgggactccatttgttttgat

SEQ ID NO: 1277 - DNA, 30 bp, Artificial sequence
  Synthetic nucleic acid sequence
acactccagctgggggagacgcggccctgt

SEQ ID NO: 1278 - DNA, 29 bp, Artificial sequence
  Synthetic nucleic acid sequence
acactccagctgggtaccacagggtagaa

SEQ ID NO: 1279 - DNA, 30 bp, Artificial sequence
  Synthetic nucleic acid sequence
acactccagctgggtgccctgtggactcag

SEQ ID NO: 1280 - DNA, 28 bp, Artificial sequence
  Synthetic nucleic acid sequence
acactccagctggggtgtgtggaaatgc

SEQ ID NO: 1281 - DNA, 29 bp, Artificial sequence
  Synthetic nucleic acid sequence
acactccagctgggctagactgaagctcc

SEQ ID NO: 1282 - DNA, 31 bp, Artificial sequence
  Synthetic nucleic acid sequence
acactccagctgggttaatgctaatcgtgat

SEQ ID NO: 1283 - DNA, 32 bp, Artificial sequence
  Synthetic nucleic acid sequence
acactccagctgggtttggcaatggtagaact

SEQ ID NO: 1284 - DNA, 26 bp, Artificial sequence
  Synthetic nucleic acid sequence
acactccagctgggtccagtgccctc

SEQ ID NO: 1285 - DNA, 35 bp, Artificial sequence
  Synthetic nucleic acid sequence
acactccagctgggattgatcatcgacacttcgaa

SEQ ID NO: 1286 - DNA, 26 bp, Artificial sequence
  Synthetic nucleic acid sequence
acactccagctgggtgaggcagtaga

SEQ ID NO: 1287 - DNA, 31 bp, Artificial sequence; identical to SEQ ID NO: 1018
  Synthetic nucleic acid sequence

SEQ ID NO: 1288 - DNA, 30 bp, Artificial sequence
  Synthetic nucleic acid sequence
acactccagctgggtgggtctttgcgggcg

SEQ ID NO: 1289 - DNA, 30 bp, Artificial sequence
  Synthetic nucleic acid sequence
acactccagctgggaactggccctcaaagt

SEQ ID NO: 1290 - DNA, 30 bp, Artificial sequence
  Synthetic nucleic acid sequence
acactccagctgggggtccagaggggagat

SEQ ID NO: 1291 - DNA, 31 bp, Artificial sequence
  Synthetic nucleic acid sequence
acactccagctgggcccagtgtttagactat

SEQ ID NO: 1292 - DNA, 28 bp, Artificial sequence
  Synthetic nucleic acid sequence
acactccagctgggagaggtatagggca

SEQ ID NO: 1293 - DNA, 30 bp, Artificial sequence; identical to SEQ ID NO: 1038
  Synthetic nucleic acid sequence

SEQ ID NO: 1294 - DNA, 29 bp, Artificial sequence
  Synthetic nucleic acid sequence
acactccagctgggtaacagtctccagtc

SEQ ID NO: 1295 - DNA, 29 bp, Artificial sequence
  Synthetic nucleic acid sequence
acactccagctgggatgacctatgaattg

SEQ ID NO: 1296 - DNA, 31 bp, Artificial sequence
  Synthetic nucleic acid sequence
acactccagctgggtactgcatcaggaactg

SEQ ID NO: 1297 - DNA, 30 bp, Artificial sequence
  Synthetic nucleic acid sequence
acactccagctgggagagttgagtctggac

SEQ ID NO: 1298 - DNA, 30 bp, Artificial sequence
  Synthetic nucleic acid sequence
acactccagctgggagaattgtggctggac

SEQ ID NO: 1299 - DNA, 29 bp, Artificial sequence
  Synthetic nucleic acid sequence
acactccagctgggccacaccgtatctga

SEQ ID NO: 1300 - DNA, 29 bp, Artificial sequence
  Synthetic nucleic acid sequence
acactccagctgggccaccaccgtgtctg

SEQ ID NO: 1301 - DNA, 30 bp, Artificial sequence
  Synthetic nucleic acid sequence
acactccagctgggacacagggctgttgtg

SEQ ID NO: 1302 - DNA, 29 bp, Artificial sequence
  Synthetic nucleic acid sequence
acactccagctgggcaagtcactagtggt

SEQ ID NO: 1303 - DNA, 30 bp, Artificial sequence
  Synthetic nucleic acid sequence
acactccagctgggcactagattgtgagct

SEQ ID NO: 1304 - DNA, 29 bp, Artificial sequence
  Synthetic nucleic acid sequence
acactccagctgggatgtatgtgtgcatg

SEQ ID NO: 1305 - DNA, 32 bp, Artificial sequence
  Synthetic nucleic acid sequence
acactccagctgggagcagaagcagggaggtt

SEQ ID NO: 1306 - DNA, 30 bp, Artificial sequence
  Synthetic nucleic acid sequence
acactccagctgggtatgtgggatggtaaa

SEQ ID NO: 1307 - DNA, 30 bp, Artificial sequence
  Synthetic nucleic acid sequence
acactccagctgggtggtttaccgtcccac

SEQ ID NO: 1308 - DNA, 30 bp, Artificial sequence
  Synthetic nucleic acid sequence
acactccagctgggtatacaagggcagact

SEQ ID NO: 1309 - DNA, 31 bp, Artificial sequence
  Synthetic nucleic acid sequence
acactccagctgggcagtgcaatgatattgt

SEQ ID NO: 1310 - DNA, 31 bp, Artificial sequence; identical to SEQ ID NO: 1071
  Synthetic nucleic acid sequence

SEQ ID NO: 1311 - DNA, 25 bp, Artificial sequence
  Synthetic nucleic acid sequence
acactccagctgggtaagtgcttcc

SEQ ID NO: 1312 - DNA, 25 bp, Artificial sequence
  Synthetic nucleic acid sequence
acactccagctgggtaattgcttcc

SEQ ID NO: 1313 - DNA, 29 bp, Artificial sequence
  Synthetic nucleic acid sequence
acactccagctgggaggcaagatgctggc

SEQ ID NO: 1314 - DNA, 30 bp, Artificial sequence; identical to SEQ ID NO: 1080
  Synthetic nucleic acid sequence

SEQ ID NO: 1315 - DNA, 28 bp, Artificial sequence
  Synthetic nucleic acid sequence
acactccagctgggaaaagctgggttga

SEQ ID NO: 1316 - DNA, 27 bp, Artificial sequence
  Synthetic nucleic acid sequence
acactccagctgggaaaagctgggttg

SEQ ID NO: 1317 - DNA, 28 bp, Artificial sequence
  Synthetic nucleic acid sequence
acactccagctgggactgccccaggtgc

SEQ ID NO: 1318 - DNA, 31 bp, Artificial sequence
  Synthetic nucleic acid sequence
acactccagctgggcctagtaggtgtccagt

SEQ ID NO: 1319 - DNA, 28 bp, Artificial sequence
  Synthetic nucleic acid sequence
acactccagctgggcctctgggcccttc

SEQ ID NO: 1320 - DNA, 30 bp, Artificial sequence
  Synthetic nucleic acid sequence
acactccagctgggaacacacctggttaac

SEQ ID NO: 1321 - DNA, 31 bp, Artificial sequence
  Synthetic nucleic acid sequence
acactccagctggggcaaagcacacggcctg

SEQ ID NO: 1322 - DNA, 30 bp, Artificial sequence
  Synthetic nucleic acid sequence
acactccagctgggctcctatatgatgcct

SEQ ID NO: 1323 - DNA, 29 bp, Artificial sequence
  Synthetic nucleic acid sequence
acactccagctggggaacggcttcataca

SEQ ID NO: 1324 - DNA, 31 bp, Artificial sequence
  Synthetic nucleic acid sequence
acactccagctgggtgagcgcctcgacgaca

SEQ ID NO: 1325 - DNA, 28 bp, Artificial sequence
  Synthetic nucleic acid sequence
acactccagctggggtgcattgctgttg

SEQ ID NO: 1326 - DNA, 29 bp, Artificial sequence
  Synthetic nucleic acid sequence
acactccagctgggaggggtgctatctgt

SEQ ID NO: 1327 - DNA, 30 bp, Artificial sequence
  Synthetic nucleic acid sequence
acactccagctggggctgactcctagtcca

SEQ ID NO: 1328 - DNA, 31 bp, Artificial sequence
  Synthetic nucleic acid sequence
acactccagctgggtgtctgcccgcatgcct

SEQ ID NO: 1329 - DNA, 30 bp, Artificial sequence
  Synthetic nucleic acid sequence
acactccagctgggcaatcactaactccac

SEQ ID NO: 1330 - DNA, 30 bp, Artificial sequence
  Synthetic nucleic acid sequence
acactccagctgggaatcactaaccacacg

SEQ ID NO: 1331 - DNA, 31 bp, Artificial sequence
  Synthetic nucleic acid sequence
acactccagctgggtcccccaggtgtgattc

SEQ ID NO: 1332 - DNA, 30 bp, Artificial sequence
  Synthetic nucleic acid sequence
acactccagctgggaacacacctattcaag

SEQ ID NO: 1333 - DNA, 32 bp, Artificial sequence
  Synthetic nucleic acid sequence
acactccagctgggaatccttggaacctaggt

SEQ ID NO: 1334 - DNA, 31 bp, Artificial sequence
  Synthetic nucleic acid sequence
acactccagctgggaagtgccgccatctttt

SEQ ID NO: 1335 - DNA, 28 bp, Artificial sequence
  Synthetic nucleic acid sequence
acactccagctgggactcaaactgtggg

SEQ ID NO: 1336 - DNA, 31 bp, Artificial sequence
  Synthetic nucleic acid sequence
acactccagctgggaaagtgctgcgacattt

SEQ ID NO: 1337 - DNA, 31 bp, Artificial sequence
  Synthetic nucleic acid sequence
acactccagctggggaagtgcttcgattttg

SEQ ID NO: 1338 - DNA, 30 bp, Artificial sequence
  Synthetic nucleic acid sequence
acactccagctgggttataatacaacctga

SEQ ID NO: 1339 - DNA, 29 bp, Artificial sequence
  Synthetic nucleic acid sequence
acactccagctgggatcatagaggaaaat

SEQ ID NO: 1340 - DNA, 30 bp, Artificial sequence
  Synthetic nucleic acid sequence
acactccagctgggatcatagaggaaaatc

SEQ ID NO: 1341 - DNA, 29 bp, Artificial sequence
  Synthetic nucleic acid sequence
acactccagctgggaacatagaggaaatt

SEQ ID NO: 1342 - DNA, 30 bp, Artificial sequence
  Synthetic nucleic acid sequence
acactccagctgggtatgtaatatggtcca

SEQ ID NO: 1343 - DNA, 30 bp, Artificial sequence
  Synthetic nucleic acid sequence
acactccagctgggagatcagaaggtgatt

SEQ ID NO: 1344 - DNA, 28 bp, Artificial sequence
  Synthetic nucleic acid sequence
acactccagctgggattcctagaaattg

SEQ ID NO: 1345 - DNA, 31 bp, Artificial sequence
  Synthetic nucleic acid sequence
acactccagctgggacttcacctggtccact

SEQ ID NO: 1346 - DNA, 30 bp, Artificial sequence
  Synthetic nucleic acid sequence
acactccagctgggactggacttagggtca

SEQ ID NO: 1347 - DNA, 30 bp, Artificial sequence
  Synthetic nucleic acid sequence
acactccagctgggcagcagcaattcatgt

SEQ ID NO: 1348 - DNA, 30 bp, Artificial sequence
  Synthetic nucleic acid sequence
acactccagctgggtaatactgtctggtaa

SEQ ID NO: 1349 - DNA, 31 bp, Artificial sequence
  Synthetic nucleic acid sequence
acactccagctgggtcttggagtaggtcatt

SEQ ID NO: 1350 - DNA, 30 bp, Artificial sequence
  Synthetic nucleic acid sequence
acactccagctgggaggcagtgtattgtta

SEQ ID NO: 1351 - DNA, 30 bp, Artificial sequence
  Synthetic nucleic acid sequence
acactccagctgggttgggatcattttgca

SEQ ID NO: 1352 - DNA, 30 bp, Artificial sequence
  Synthetic nucleic acid sequence
acactccagctgggttttgcaatatgttcc

SEQ ID NO: 1353 - DNA, 30 bp, Artificial sequence
  Synthetic nucleic acid sequence
acactccagctgggaactgtttgcagagga

SEQ ID NO: 1354 - DNA, 31 bp, Artificial sequence
  Synthetic nucleic acid sequence
acactccagctgggaggttgtccgtggtgag

SEQ ID NO: 1355 - DNA, 31 bp, Artificial sequence
  Synthetic nucleic acid sequence
acactccagctgggtagtgcaatattgctta

SEQ ID NO: 1356 - DNA, 29 bp, Artificial sequence
  Synthetic nucleic acid sequence
acactccagctggggcagtccatgggcat

SEQ ID NO: 1357 - DNA, 30 bp, Artificial sequence
  Synthetic nucleic acid sequence
acactccagctgggtatgtgcctttggact

SEQ ID NO: 1358 - DNA, 29 bp, Artificial sequence
  Synthetic nucleic acid sequence
acactccagctgggtcactcctctcctcc

SEQ ID NO: 1359 - DNA, 30 bp, Artificial sequence
  Synthetic nucleic acid sequence
acactccagctgggaagacgggaggaaaga

SEQ ID NO: 1360 - DNA, 30 bp, Artificial sequence
  Synthetic nucleic acid sequence
acactccagctggggtcatacacggctctc

SEQ ID NO: 1361 - DNA, 29 bp, Artificial sequence
  Synthetic nucleic acid sequence
acactccagctgggcggggcagctcagta

SEQ ID NO: 1362 - DNA, 30 bp, Artificial sequence
  Synthetic nucleic acid sequence
acactccagctgggaatcatacagggacat

SEQ ID NO: 1363 - DNA, 29 bp, Artificial sequence
  Synthetic nucleic acid sequence
acactccagctgggttgaaaggctatttc

SEQ ID NO: 1364 - DNA, 30 bp, Artificial sequence
  Synthetic nucleic acid sequence
acactccagctggggtgacatcacatatac

SEQ ID NO: 1365 - DNA, 28 bp, Artificial sequence
  Synthetic nucleic acid sequence
acactccagctgggccatggatctccag

SEQ ID NO: 1366 - DNA, 30 bp, Artificial sequence
  Synthetic nucleic acid sequence
acactccagctgggcttatgcaagattccc

SEQ ID NO: 1367 - DNA, 31 bp, Artificial sequence
  Synthetic nucleic acid sequence
acactccagctgggaggacctgcgggacaag

SEQ ID NO: 1368 - DNA, 30 bp, Artificial sequence
  Synthetic nucleic acid sequence
acactccagctgggtgaaggtctactgtgt

SEQ ID NO: 1369 - DNA, 29 bp, Artificial sequence
  Synthetic nucleic acid sequence
acactccagctgggcagcagcacactgtg

SEQ ID NO: 1370 - DNA, 31 bp, Artificial sequence
  Synthetic nucleic acid sequence
acactccagctgggtttcaagccagggggcg

SEQ ID NO: 1371 - DNA, 30 bp, Artificial sequence
  Synthetic nucleic acid sequence
acactccagctgggaacatcacagcaagtc

SEQ ID NO: 1372 - DNA, 31 bp, Artificial sequence
  Synthetic nucleic acid sequence
acactccagctgggtaatccttgctacctgg

SEQ ID NO: 1373 - DNA, 30 bp, Artificial sequence
  Synthetic nucleic acid sequence
acactccagctgggaatgcacccgggcaag

SEQ ID NO: 1374 - DNA, 30 bp, Artificial sequence
  Synthetic nucleic acid sequence
acactccagctgggaatcctttgtccctgg

SEQ ID NO: 1375 - DNA, 30 bp, Artificial sequence
  Synthetic nucleic acid sequence
acactccagctgggaatgcacctgggcaag

SEQ ID NO: 1376 - DNA, 29 bp, Artificial sequence
  Synthetic nucleic acid sequence
acactccagctgggatccttgctatctgg

SEQ ID NO: 1377 - DNA, 31 bp, Artificial sequence
  Synthetic nucleic acid sequence
acactccagctgggtagcagcgggaacagtt

SEQ ID NO: 1378 - DNA, 30 bp, Artificial sequence
  Synthetic nucleic acid sequence
acactccagctgggcgtcaacacttgctgg

SEQ ID NO: 1379 - DNA, 29 bp, Artificial sequence
  Synthetic nucleic acid sequence
acactccagctgggtaaggcacccttctg

SEQ ID NO: 1380 - DNA, 29 bp, Artificial sequence
  Synthetic nucleic acid sequence
acactccagctgggttttgcaccttttgg

SEQ ID NO: 1381 - DNA, 31 bp, Artificial sequence
  Synthetic nucleic acid sequence
acactccagctgggtgattgtagccttttgg

SEQ ID NO: 1382 - DNA, 31 bp, Artificial sequence
  Synthetic nucleic acid sequence
acactccagctgggtactccagagggcgtca

SEQ ID NO: 1383 - DNA, 30 bp, Artificial sequence
  Synthetic nucleic acid sequence
acactccagctgggtactgcagacgtggca

SEQ ID NO: 1384 - DNA, 30 bp, Artificial sequence
  Synthetic nucleic acid sequence
acactccagctgggtgattggtacgtctgt

SEQ ID NO: 1385 - DNA, 29 bp, Artificial sequence
  Synthetic nucleic acid sequence
acactccagctgggtactgcagacagtgg

SEQ ID NO: 1386 - DNA, 30 bp, Artificial sequence
  Synthetic nucleic acid sequence
acactccagctgggtactcaggagagtggc

SEQ ID NO: 1387 - DNA, 29 bp, Artificial sequence
  Synthetic nucleic acid sequence
acactccagctggggtgtcttttgctctg

SEQ ID NO: 1388 - DNA, 30 bp, Artificial sequence
  Synthetic nucleic acid sequence
acactccagctgggaagtgctgtcatagct

SEQ ID NO: 1389 - DNA, 31 bp, Artificial sequence
  Synthetic nucleic acid sequence
acactccagctgggcactcagccttgagggc

SEQ ID NO: 1390 - DNA, 31 bp, Artificial sequence
  Synthetic nucleic acid sequence
acactccagctgggtaaatttcacctttctg

SEQ ID NO: 1391 - DNA, 26 bp, Artificial sequence
  Synthetic nucleic acid sequence
acactccagctgggttcacagggagg

SEQ ID NO: 1392 - DNA, 30 bp, Artificial sequence
  Synthetic nucleic acid sequence
acactccagctgggttcacaaggaggtgtc

SEQ ID NO: 1393 - DNA, 30 bp, Artificial sequence
  Synthetic nucleic acid sequence
acactccagctgggttctcaaggaggtgtc

SEQ ID NO: 1394 - DNA, 29 bp, Artificial sequence
  Synthetic nucleic acid sequence
acactccagctgggattgacacttctgtg

SEQ ID NO: 1395 - DNA, 30 bp, Artificial sequence
  Synthetic nucleic acid sequence
acactccagctggggagtgccttcttttgg

SEQ ID NO: 1396 - DNA, 32 bp, Artificial sequence
  Synthetic nucleic acid sequence
acactccagctgggttctccaaaagaaagcac

SEQ ID NO: 1397 - DNA, 26 bp, Artificial sequence
  Synthetic nucleic acid sequence
acactccagctgggtgcttcctttca

SEQ ID NO: 1398 - DNA, 31 bp, Artificial sequence
  Synthetic nucleic acid sequence
acactccagctgggttctcgaggaaagaagc

SEQ ID NO: 1399 - DNA, 30 bp, Artificial sequence
  Synthetic nucleic acid sequence
acactccagctgggatctggaggtaagaag

SEQ ID NO: 1400 - DNA, 30 bp, Artificial sequence
  Synthetic nucleic acid sequence
acactccagctgggatcgtgcatcccttta

SEQ ID NO: 1401 - DNA, 30 bp, Artificial sequence
  Synthetic nucleic acid sequence
acactccagctgggtcgtgcatccctttag

SEQ ID NO: 1402 - DNA, 30 bp, Artificial sequence
  Synthetic nucleic acid sequence
acactccagctgggatcgtgcatcctttta

SEQ ID NO: 1403 - DNA, 30 bp, Artificial sequence
  Synthetic nucleic acid sequence
acactccagctggggaaagcgcttcccttt

SEQ ID NO: 1404 - DNA, 28 bp, Artificial sequence
  Synthetic nucleic acid sequence
acactccagctgggctgcaaagggaagc

SEQ ID NO: 1405 - DNA, 30 bp, Artificial sequence
  Synthetic nucleic acid sequence
acactccagctgggcaaagcgctccccttt

SEQ ID NO: 1406 - DNA, 31 bp, Artificial sequence
  Synthetic nucleic acid sequence
acactccagctgggcaaagcgcttctcttta

SEQ ID NO: 1407 - DNA, 29 bp, Artificial sequence
  Synthetic nucleic acid sequence
acactccagctgggcaaagcgcttccctt

SEQ ID NO: 1408 - DNA, 30 bp, Artificial sequence
  Synthetic nucleic acid sequence
acactccagctgggctctagagggaagcac

SEQ ID NO: 1409 - DNA, 29 bp, Artificial sequence
  Synthetic nucleic acid sequence
acactccagctgggaaagcgcttcccttc

SEQ ID NO: 1410 - DNA, 29 bp, Artificial sequence
  Synthetic nucleic acid sequence
acactccagctggggaaagcgcttctctt

SEQ ID NO: 1411 - DNA, 30 bp, Artificial sequence
  Synthetic nucleic acid sequence
acactccagctgggaaagtgcatcctttta

SEQ ID NO: 1412 - DNA, 30 bp, Artificial sequence; identical to SEQ ID NO: 1411
  Synthetic nucleic acid sequence

SEQ ID NO: 1413 - DNA, 30 bp, Artificial sequence
  Synthetic nucleic acid sequence
acactccagctgggctctagagggaagcgc

SEQ ID NO: 1414 - DNA, 30 bp, Artificial sequence
  Synthetic nucleic acid sequence
acactccagctgggaaagtgcatcttttta

SEQ ID NO: 1415 - DNA, 30 bp, Artificial sequence; identical to SEQ ID NO: 1413
  Synthetic nucleic acid sequence

SEQ ID NO: 1416 - DNA, 30 bp, Artificial sequence
  Synthetic nucleic acid sequence
acactccagctgggcaaagtgcctcccttt

SEQ ID NO: 1417 - DNA, 30 bp, Artificial sequence
  Synthetic nucleic acid sequence
acactccagctgggaagtgcctccttttag

SEQ ID NO: 1418 - DNA, 30 bp, Artificial sequence
  Synthetic nucleic acid sequence
acactccagctgggaaagtgcttccctttg

SEQ ID NO: 1419 - DNA, 29 bp, Artificial sequence
  Synthetic nucleic acid sequence
acactccagctgggctccagagggaagta

SEQ ID NO: 1420 - DNA, 29 bp, Artificial sequence
  Synthetic nucleic acid sequence
acactccagctgggaaagtgcttcctttt

SEQ ID NO: 1421 - DNA, 30 bp, Artificial sequence
  Synthetic nucleic acid sequence
acactccagctgggaaagtgcttcctttta

SEQ ID NO: 1422 - DNA, 30 bp, Artificial sequence; identical to SEQ ID NO: 1408
  Synthetic nucleic acid sequence

SEQ ID NO: 1423 - DNA, 30 bp, Artificial sequence
  Synthetic nucleic acid sequence
acactccagctgggaaagtgcttctctttg

SEQ ID NO: 1424 - DNA, 28 bp, Artificial sequence
  Synthetic nucleic acid sequence
acactccagctgggctacaaagggaagc

SEQ ID NO: 1425 - DNA, 29 bp, Artificial sequence
  Synthetic nucleic acid sequence
acactccagctgggaaagtgcttcctttt

SEQ ID NO: 1426 - DNA, 30 bp, Artificial sequence
  Synthetic nucleic acid sequence
acactccagctgggaagtgcttccttttag

SEQ ID NO: 1427 - DNA, 32 bp, Artificial sequence
  Synthetic nucleic acid sequence
acactccagctgggacaaagtgcttcccttta

SEQ ID NO: 1428 - DNA, 30 bp, Artificial sequence
  Synthetic nucleic acid sequence
acactccagctgggacaaagtgcttccctt

SEQ ID NO: 1429 - DNA, 30 bp, Artificial sequence
  Synthetic nucleic acid sequence
acactccagctgggaacgcacttcccttta

SEQ ID NO: 1430 - DNA, 30 bp, Artificial sequence
  Synthetic nucleic acid sequence
acactccagctgggaaaatggttcccttta

SEQ ID NO: 1431 - DNA, 31 bp, Artificial sequence
  Synthetic nucleic acid sequence
acactccagctggggaacgcgcttccctata

SEQ ID NO: 1432 - DNA, 29 bp, Artificial sequence
  Synthetic nucleic acid sequence
acactccagctggggaaggcgcttccctt

SEQ ID NO: 1433 - DNA, 30 bp, Artificial sequence
  Synthetic nucleic acid sequence
acactccagctgggctacaaagggaagcac

SEQ ID NO: 1434 - DNA, 30 bp, Artificial sequence
  Synthetic nucleic acid sequence
acactccagctggggaaggcgcttcccttt

SEQ ID NO: 1435 - DNA, 29 bp, Artificial sequence
  Synthetic nucleic acid sequence
acactccagctgggctccagagggatgca

SEQ ID NO: 1436 - DNA, 30 bp, Artificial sequence; identical to SEQ ID NO: 1408
  Synthetic nucleic acid sequence

SEQ ID NO: 1437 - DNA, 31 bp, Artificial sequence
  Synthetic nucleic acid sequence
acactccagctgggctcttgagggaagcact

SEQ ID NO: 1438 - DNA, 28 bp, Artificial sequence
  Synthetic nucleic acid sequence
acactccagctgggctgcaaagggaagc

SEQ ID NO: 1439 - DNA, 30 bp, Artificial sequence
  Synthetic nucleic acid sequence
acactccagctgggtggtgggcacagaatc

SEQ ID NO: 1440 - DNA, 31 bp, Artificial sequence
  Synthetic nucleic acid sequence
acactccagctgggtcggggatcatcatgtc

SEQ ID NO: 1441 - DNA, 30 bp, Artificial sequence
  Synthetic nucleic acid sequence
acactccagctgggattctgcatttttagc

SEQ ID NO: 1442 - DNA, 30 bp, Artificial sequence
  Synthetic nucleic acid sequence
acactccagctgggtcagcaaacatttatt

SEQ ID NO: 1443 - DNA, 30 bp, Artificial sequence
  Synthetic nucleic acid sequence
acactccagctgggcaaaactggcaattac

SEQ ID NO: 1444 - DNA, 30 bp, Artificial sequence
  Synthetic nucleic acid sequence
acactccagctgggaaaagtaattgcgagt

SEQ ID NO: 1445 - DNA, 30 bp, Artificial sequence
  Synthetic nucleic acid sequence
acactccagctgggcaagaacctcagttgc

SEQ ID NO: 1446 - DNA, 30 bp, Artificial sequence
  Synthetic nucleic acid sequence
acactccagctgggaaaagtaattgtggtt

SEQ ID NO: 1447 - DNA, 30 bp, Artificial sequence
  Synthetic nucleic acid sequence
acactccagctgggcaaaaatctcaattac

SEQ ID NO: 1448 - DNA, 30 bp, Artificial sequence
  Synthetic nucleic acid sequence
acactccagctgggaaaagtaattgcggtt

SEQ ID NO: 1449 - DNA, 30 bp, Artificial sequence
  Synthetic nucleic acid sequence
acactccagctgggcaaaaaccacagtttc

SEQ ID NO: 1450 - DNA, 30 bp, Artificial sequence; identical to SEQ ID NO: 1446
  Synthetic nucleic acid sequence

SEQ ID NO: 1451 - DNA, 30 bp, Artificial sequence
  Synthetic nucleic acid sequence
acactccagctgggaaaaactgagactact

SEQ ID NO: 1452 - DNA, 27 bp, Artificial sequence
  Synthetic nucleic acid sequence
acactccagctgggaaaaactgtaatt

SEQ ID NO: 1453 - DNA, 30 bp, Artificial sequence
  Synthetic nucleic acid sequence
acactccagctgggaaaactgtaattactt

SEQ ID NO: 1454 - DNA, 30 bp, Artificial sequence
  Synthetic nucleic acid sequence
acactccagctgggaaaagtaatcgcggtt

SEQ ID NO: 1455 - DNA, 30 bp, Artificial sequence
  Synthetic nucleic acid sequence
acactccagctgggaaaagtaattgcggat

SEQ ID NO: 1456 - DNA, 30 bp, Artificial sequence
  Synthetic nucleic acid sequence
acactccagctgggaaaagtaattgcggtc

SEQ ID NO: 1457 - DNA, 30 bp, Artificial sequence
  Synthetic nucleic acid sequence
acactccagctgggaaaagtacttgcggat

SEQ ID NO: 1458 - DNA, 30 bp, Artificial sequence
  Synthetic nucleic acid sequence
acactccagctgggaaaagtatttgcgggt

SEQ ID NO: 1459 - DNA, 29 bp, Artificial sequence
  Synthetic nucleic acid sequence
acactccagctgggcaaaggtatttgtgg

SEQ ID NO: 1460 - DNA, 30 bp, Artificial sequence
  Synthetic nucleic acid sequence
acactccagctgggcaaaagtaattgtgga

SEQ ID NO: 1461 - DNA, 30 bp, Artificial sequence
  Synthetic nucleic acid sequence
acactccagctgggccaaaactgcagttac

SEQ ID NO: 1462 - DNA, 30 bp, Artificial sequence
  Synthetic nucleic acid sequence
acactccagctgggtagcaaaaactgcagt

SEQ ID NO: 1463 - DNA, 29 bp, Artificial sequence
  Synthetic nucleic acid sequence
acactccagctgggtgacaactatggatg

SEQ ID NO: 1464 - DNA, 31 bp, Artificial sequence
  Synthetic nucleic acid sequence
acactccagctgggagtgcctgagggagtaa

SEQ ID NO: 1465 - DNA, 29 bp, Artificial sequence
  Synthetic nucleic acid sequence
acactccagctggggcgacccactcttgg

SEQ ID NO: 1466 - DNA, 29 bp, Artificial sequence
  Synthetic nucleic acid sequence
acactccagctgggaacaggtgactggtt

SEQ ID NO: 1467 - DNA, 29 bp, Artificial sequence
  Synthetic nucleic acid sequence
acactccagctgggaaaacggtgagattt

SEQ ID NO: 1468 - DNA, 29 bp, Artificial sequence
  Synthetic nucleic acid sequence
acactccagctggggctagtcctgactca

SEQ ID NO: 1469 - DNA, 29 bp, Artificial sequence
  Synthetic nucleic acid sequence
acactccagctgggagggtaagctgaacc

SEQ ID NO: 1470 - DNA, 30 bp, Artificial sequence
  Synthetic nucleic acid sequence
acactccagctgggatattaccattagctc

SEQ ID NO: 1471 - DNA, 30 bp, Artificial sequence
  Synthetic nucleic acid sequence
acactccagctggggatgagctcattgtaa

SEQ ID NO: 1472 - DNA, 31 bp, Artificial sequence
  Synthetic nucleic acid sequence
acactccagctggggtttgcacgggtgggcc

SEQ ID NO: 1473 - DNA, 27 bp, Artificial sequence
  Synthetic nucleic acid sequence
acactccagctgggtgagctgctgtac

SEQ ID NO: 1474 - DNA, 29 bp, Artificial sequence
  Synthetic nucleic acid sequence
acactccagctgggtaaagtaaatatgca

SEQ ID NO: 1475 - DNA, 30 bp, Artificial sequence
  Synthetic nucleic acid sequence
acactccagctgggcaaagtttaagatcct

SEQ ID NO: 1476 - DNA, 28 bp, Artificial sequence
  Synthetic nucleic acid sequence
acactccagctgggaaagtagctgtacc

SEQ ID NO: 1477 - DNA, 27 bp, Artificial sequence
  Synthetic nucleic acid sequence
acactccagctgggaggttgacatacg

SEQ ID NO: 1478 - DNA, 27 bp, Artificial sequence
  Synthetic nucleic acid sequence
acactccagctgggaggcacggtgtca

SEQ ID NO: 1479 - DNA, 27 bp, Artificial sequence
  Synthetic nucleic acid sequence
acactccagctggggggcgcctgtgat

SEQ ID NO: 1480 - DNA, 31 bp, Artificial sequence
  Synthetic nucleic acid sequence
acactccagctgggagtatgttcttccagga

SEQ ID NO: 1481 - DNA, 29 bp, Artificial sequence
  Synthetic nucleic acid sequence
acactccagctgggagttaatgaatcctg

SEQ ID NO: 1482 - DNA, 30 bp, Artificial sequence
  Synthetic nucleic acid sequence
acactccagctgggcgaaaacagcaattac

SEQ ID NO: 1483 - DNA, 29 bp, Artificial sequence
  Synthetic nucleic acid sequence
acactccagctgggtgagttggccatctg

SEQ ID NO: 1484 - DNA, 28 bp, Artificial sequence
  Synthetic nucleic acid sequence
acactccagctggggtccgctcggcggt

SEQ ID NO: 1485 - DNA, 32 bp, Artificial sequence
  Synthetic nucleic acid sequence
acactccagctgggctgaagtgatgtgtaact

SEQ ID NO: 1486 - DNA, 27 bp, Artificial sequence
  Synthetic nucleic acid sequence
acactccagctggggagccagttggac

SEQ ID NO: 1487 - DNA, 30 bp, Artificial sequence
  Synthetic nucleic acid sequence
acactccagctgggaagatgtggaaaaatt

SEQ ID NO: 1488 - DNA, 30 bp, Artificial sequence
  Synthetic nucleic acid sequence
acactccagctgggattctaatttctccac

SEQ ID NO: 1489 - DNA, 29 bp, Artificial sequence
  Synthetic nucleic acid sequence
acactccagctgggtagataaaatattgg

SEQ ID NO: 1490 - DNA, 29 bp, Artificial sequence
  Synthetic nucleic acid sequence
acactccagctgggcttcttgtgctctag

SEQ ID NO: 1491 - DNA, 31 bp, Artificial sequence
  Synthetic nucleic acid sequence
acactccagctgggttcatttggtataaacc

SEQ ID NO: 1492 - DNA, 30 bp, Artificial sequence
  Synthetic nucleic acid sequence
acactccagctgggttgagaatgatgaatc

SEQ ID NO: 1493 - DNA, 29 bp, Artificial sequence
  Synthetic nucleic acid sequence
acactccagctgggtcttgtgttctctag

SEQ ID NO: 1494 - DNA, 30 bp, Artificial sequence
  Synthetic nucleic acid sequence
acactccagctgggtaactggttgaacaac

SEQ ID NO: 1495 - DNA, 31 bp, Artificial sequence
  Synthetic nucleic acid sequence
acactccagctgggttacagttgttcaacca

SEQ ID NO: 1496 - DNA, 29 bp, Artificial sequence
  Synthetic nucleic acid sequence
acactccagctgggcaaagaggaaggtcc

SEQ ID NO: 1497 - DNA, 30 bp, Artificial sequence
  Synthetic nucleic acid sequence
acactccagctgggttatggtttgcctggg

SEQ ID NO: 1498 - DNA, 27 bp, Artificial sequence
  Synthetic nucleic acid sequence
acactccagctgggtgggcgtatctgt

SEQ ID NO: 1499 - DNA, 30 bp, Artificial sequence
  Synthetic nucleic acid sequence
acactccagctgggtatgcattgtattttt

SEQ ID NO: 1500 - DNA, 29 bp, Artificial sequence
  Synthetic nucleic acid sequence
acactccagctgggtttccataggtgatg

SEQ ID NO: 1501 - DNA, 29 bp, Artificial sequence
  Synthetic nucleic acid sequence
acactccagctgggttggccacaatgggt

SEQ ID NO: 1502 - DNA, 30 bp, Artificial sequence
  Synthetic nucleic acid sequence
acactccagctgggtgagaaccacgtctgc

SEQ ID NO: 1503 - DNA, 28 bp, Artificial sequence
  Synthetic nucleic acid sequence
acactccagctgggagaccatgggttct

SEQ ID NO: 1504 - DNA, 30 bp, Artificial sequence
  Synthetic nucleic acid sequence
acactccagctgggttgtgtcaatatgcga

SEQ ID NO: 1505 - DNA, 27 bp, Artificial sequence
  Synthetic nucleic acid sequence
acactccagctgggtgtctctgctggg

SEQ ID NO: 1506 - DNA, 29 bp, Artificial sequence
  Synthetic nucleic acid sequence
acactccagctggggaagtgtgccgtggt

SEQ ID NO: 1507 - DNA, 29 bp, Artificial sequence
  Synthetic nucleic acid sequence
acactccagctgggaagcctgcccggctc

SEQ ID NO: 1508 - DNA, 30 bp, Artificial sequence
  Synthetic nucleic acid sequence
acactccagctgggtgtgtcactcgatgac

SEQ ID NO: 1509 - DNA, 30 bp, Artificial sequence
  Synthetic nucleic acid sequence
acactccagctgggtacgtcatcgttgtca

SEQ ID NO: 1510 - DNA, 28 bp, Artificial sequence
  Synthetic nucleic acid sequence
acactccagctggggttgtgtcagttta

SEQ ID NO: 1511 - DNA, 31 bp, Artificial sequence
  Synthetic nucleic acid sequence
acactccagctgggacttacagacaagagcc

SEQ ID NO: 1512 - DNA, 30 bp, Artificial sequence
  Synthetic nucleic acid sequence
acactccagctgggtggtctaggattgttg

SEQ ID NO: 1513 - DNA, 31 bp, Artificial sequence
  Synthetic nucleic acid sequence
acactccagctggggacacgggcgacagctg

SEQ ID NO: 1514 - DNA, 30 bp, Artificial sequence
  Synthetic nucleic acid sequence
acactccagctgggcacacactgcaattac

SEQ ID NO: 1515 - DNA, 27 bp, Artificial sequence
  Synthetic nucleic acid sequence
acactccagctgggaggctgcggaatt

SEQ ID NO: 1516 - DNA, 31 bp, Artificial sequence
  Synthetic nucleic acid sequence
acactccagctgggtaaatcccatggtgcct

SEQ ID NO: 1517 - DNA, 29 bp, Artificial sequence
  Synthetic nucleic acid sequence
acactccagctgggaaactactgaaaatc

SEQ ID NO: 1518 - DNA, 29 bp, Artificial sequence
  Synthetic nucleic acid sequence
acactccagctggggttcaaatccagatc

SEQ ID NO: 1519 - DNA, 33 bp, Artificial sequence
  Synthetic nucleic acid sequence
acactccagctgggaggggtggtgttgggacag

SEQ ID NO: 1520 - DNA, 28 bp, Artificial sequence
  Synthetic nucleic acid sequence
acactccagctgggagggtgtttctctc

SEQ ID NO: 1521 - DNA, 29 bp, Artificial sequence
  Synthetic nucleic acid sequence
acactccagctgggtgagctaaatgtgtg

SEQ ID NO: 1522 - DNA, 31 bp, Artificial sequence
  Synthetic nucleic acid sequence
acactccagctggggcgaggacccctcgggg

SEQ ID NO: 1523 - DNA, 33 bp, Artificial sequence
  Synthetic nucleic acid sequence
acactccagctggggctgggcagggcttctgag

SEQ ID NO: 1524 - DNA, 28 bp, Artificial sequence
  Synthetic nucleic acid sequence
acactccagctgggaggaatgttccttc

SEQ ID NO: 1525 - DNA, 31 bp, Artificial sequence
  Synthetic nucleic acid sequence
acactccagctggggaacgcctgttcttgcc

SEQ ID NO: 1526 - DNA, 30 bp, Artificial sequence
  Synthetic nucleic acid sequence
acactccagctgggagtcattggagggttt

SEQ ID NO: 1527 - DNA, 30 bp, Artificial sequence
  Synthetic nucleic acid sequence
acactccagctgggagacttcccatttgaa

SEQ ID NO: 1528 - DNA, 31 bp, Artificial sequence
  Synthetic nucleic acid sequence
acactccagctgggaaactctacttgtcctt

SEQ ID NO: 1529 - DNA, 32 bp, Artificial sequence
  Synthetic nucleic acid sequence
acactccagctggggacctggacatgtttgtg

SEQ ID NO: 1530 - DNA, 28 bp, Artificial sequence
  Synthetic nucleic acid sequence
acactccagctgggatggagatagatat

SEQ ID NO: 1531 - DNA, 29 bp, Artificial sequence
  Synthetic nucleic acid sequence
acactccagctgggggctagcaacagcgc

SEQ ID NO: 1532 - DNA, 29 bp, Artificial sequence
  Synthetic nucleic acid sequence
acactccagctgggacagtctgctgaggt

SEQ ID NO: 1533 - DNA, 31 bp, Artificial sequence
  Synthetic nucleic acid sequence
acactccagctgggatcccttgcaggggctg

SEQ ID NO: 1534 - DNA, 29 bp, Artificial sequence
  Synthetic nucleic acid sequence
acactccagctgggcacaaggtattggta

SEQ ID NO: 1535 - DNA, 29 bp, Artificial sequence
  Synthetic nucleic acid sequence
acactccagctgggagggggaaagttcta

SEQ ID NO: 1536 - DNA, 27 bp, Artificial sequence
  Synthetic nucleic acid sequence
acactccagctgggagctgtctgaaaa

SEQ ID NO: 1537 - DNA, 30 bp, Artificial sequence
  Synthetic nucleic acid sequence
acactccagctggggtgagtctctaagaaa

SEQ ID NO: 1538 - DNA, 29 bp, Artificial sequence
  Synthetic nucleic acid sequence
acactccagctgggtctagtaagagtggc

SEQ ID NO: 1539 - DNA, 30 bp, Artificial sequence
  Synthetic nucleic acid sequence
acactccagctgggatgctgacatatttac

SEQ ID NO: 1540 - DNA, 29 bp, Artificial sequence
  Synthetic nucleic acid sequence
acactccagctgggtgggtttacgttggg

SEQ ID NO: 1541 - DNA, 30 bp, Artificial sequence
  Synthetic nucleic acid sequence
acactccagctgggagtattctgtaccagg

SEQ ID NO: 1542 - DNA, 29 bp, Artificial sequence
  Synthetic nucleic acid sequence
acactccagctgggagacctggcccagac

SEQ ID NO: 1543 - DNA, 27 bp, Artificial sequence
  Synthetic nucleic acid sequence
acactccagctggggtgtctgcttcct

SEQ ID NO: 1544 - DNA, 31 bp, Artificial sequence
  Synthetic nucleic acid sequence
acactccagctgggctaatagtatctaccac

SEQ ID NO: 1545 - DNA, 30 bp, Artificial sequence
  Synthetic nucleic acid sequence
acactccagctgggaaccagcaccccaact

SEQ ID NO: 1546 - DNA, 31 bp, Artificial sequence
  Synthetic nucleic acid sequence
acactccagctgggacttgggcactgaaaca

SEQ ID NO: 1547 - DNA, 31 bp, Artificial sequence
  Synthetic nucleic acid sequence
acactccagctgggtgtgcttgctcgtcccg

SEQ ID NO: 1548 - DNA, 32 bp, Artificial sequence
  Synthetic nucleic acid sequence
acactccagctgggactgggggctttcgggct

SEQ ID NO: 1549 - DNA, 33 bp, Artificial sequence
  Synthetic nucleic acid sequence
acactccagctgggagggatcgcgggcgggtgg

SEQ ID NO: 1550 - DNA, 31 bp, Artificial sequence
  Synthetic nucleic acid sequence
acactccagctgggatcgctgcggttgcgag

SEQ ID NO: 1551 - DNA, 29 bp, Artificial sequence
  Synthetic nucleic acid sequence
acactccagctgggatgatccaggaacct

SEQ ID NO: 1552 - DNA, 32 bp, Artificial sequence
  Synthetic nucleic acid sequence
acactccagctgggaaagacataggatagagt

SEQ ID NO: 1553 - DNA, 30 bp, Artificial sequence
  Synthetic nucleic acid sequence
acactccagctggggtccctctccaaatgt

SEQ ID NO: 1554 - DNA, 30 bp, Artificial sequence
  Synthetic nucleic acid sequence
acactccagctgggacttgtatgctagctc

SEQ ID NO: 1555 - DNA, 27 bp, Artificial sequence
  Synthetic nucleic acid sequence
acactccagctgggagtgtggctttct

SEQ ID NO: 1556 - DNA, 27 bp, Artificial sequence
  Synthetic nucleic acid sequence
acactccagctgggtctaggctggtac

SEQ ID NO: 1557 - DNA, 27 bp, Artificial sequence
  Synthetic nucleic acid sequence
acactccagctgggaagcagctgcctc

SEQ ID NO: 1558 - DNA, 29 bp, Artificial sequence
  Synthetic nucleic acid sequence
acactccagctggggtggctgcactcact

SEQ ID NO: 1559 - DNA, 27 bp, Artificial sequence
  Synthetic nucleic acid sequence
acactccagctgggaagtgtgcagggc

SEQ ID NO: 1560 - DNA, 30 bp, Artificial sequence
  Synthetic nucleic acid sequence
acactccagctgggaaacctgtgttgttca

SEQ ID NO: 1561 - DNA, 29 bp, Artificial sequence
  Synthetic nucleic acid sequence
acactccagctgggaggaggcagcgctct

SEQ ID NO: 1562 - DNA, 30 bp, Artificial sequence
  Synthetic nucleic acid sequence
acactccagctgggtttaggataagcttga

SEQ ID NO: 1563 - DNA, 30 bp, Artificial sequence
  Synthetic nucleic acid sequence
acactccagctgggtggtgggccgcagaac

SEQ ID NO: 1564 - DNA, 30 bp, Artificial sequence
  Synthetic nucleic acid sequence
acactccagctgggataatacatggttaac

SEQ ID NO: 1565 - DNA, 29 bp, Artificial sequence
  Synthetic nucleic acid sequence
acactccagctgggaatattatacagtca

SEQ ID NO: 1566 - DNA, 31 bp, Artificial sequence
  Synthetic nucleic acid sequence
acactccagctgggggcaggttctcaccctc

SEQ ID NO: 1567 - DNA, 33 bp, Artificial sequence
  Synthetic nucleic acid sequence
acactccagctgggggcggagggaagtaggtcc

SEQ ID NO: 1568 - DNA, 30 bp, Artificial sequence
  Synthetic nucleic acid sequence
acactccagctgggcttggttcagggaggg

SEQ ID NO: 1569 - DNA, 30 bp, Artificial sequence
  Synthetic nucleic acid sequence
acactccagctgggtacccattgcatatcg

SEQ ID NO: 1570 - DNA, 32 bp, Artificial sequence
  Synthetic nucleic acid sequence
acactccagctgggtgcctgggtctctggcct

SEQ ID NO: 1571 - DNA, 29 bp, Artificial sequence
  Synthetic nucleic acid sequence
acactccagctgggtcccacgttgtggcc

SEQ ID NO: 1572 - DNA, 30 bp, Artificial sequence
  Synthetic nucleic acid sequence
acactccagctgggaggcggggcgccgcgg

SEQ ID NO: 1573 - DNA, 30 bp, Artificial sequence
  Synthetic nucleic acid sequence
acactccagctgggggtggcccggccgtgc

SEQ ID NO: 1574 - DNA, 31 bp, Artificial sequence
  Synthetic nucleic acid sequence
acactccagctgggtattcatttatccccag

SEQ ID NO: 1575 - DNA, 28 bp, Artificial sequence
  Synthetic nucleic acid sequence
acactccagctgggaccaggaggctgag

SEQ ID NO: 1576 - DNA, 31 bp, Artificial sequence
  Synthetic nucleic acid sequence
acactccagctgggtgtcactcggctcggcc

SEQ ID NO: 1577 - DNA, 31 bp, Artificial sequence
  Synthetic nucleic acid sequence
acactccagctgggtggtgcggagagggccc

SEQ ID NO: 1578 - DNA, 25 bp, Artificial sequence
  Synthetic nucleic acid sequence
acactccagctgggtctcgctgggg

SEQ ID NO: 1579 - DNA, 30 bp, Artificial sequence
  Synthetic nucleic acid sequence
acactccagctgggtttgtgacctggtcca

SEQ ID NO: 1580 - DNA, 29 bp, Artificial sequence
  Synthetic nucleic acid sequence
acactccagctgggtggaggagaaggaag

SEQ ID NO: 1581 - DNA, 30 bp, Artificial sequence
  Synthetic nucleic acid sequence
acactccagctgggactccagccccacagc

SEQ ID NO: 1582 - DNA, 31 bp, Artificial sequence
  Synthetic nucleic acid sequence
acactccagctgggtctgctcataccccatg

SEQ ID NO: 1583 - DNA, 31 bp, Artificial sequence
  Synthetic nucleic acid sequence
acactccagctgggtgcaccatggttgtctg

SEQ ID NO: 1584 - DNA, 36 bp, Artificial sequence
  Synthetic nucleic acid sequence
acactccagctgggtcacaatgctgacactcaaact

SEQ ID NO: 1585 - DNA, 34 bp, Artificial sequence
  Synthetic nucleic acid sequence
acactccagctggggttggaggatgaaagtacgg

SEQ ID NO: 1586 - DNA, 31 bp, Artificial sequence
  Synthetic nucleic acid sequence
acactccagctgggctgggatctccggggtc

SEQ ID NO: 1587 - DNA, 30 bp, Artificial sequence
  Synthetic nucleic acid sequence
acactccagctgggtgagacctctgggttc

SEQ ID NO: 1588 - DNA, 31 bp, Artificial sequence
  Synthetic nucleic acid sequence
acactccagctgggtccagtaccacgtgtca

SEQ ID NO: 1589 - DNA, 31 bp, Artificial sequence
  Synthetic nucleic acid sequence
acactccagctgggcagtaacaaagattcat

SEQ ID NO: 1590 - DNA, 29 bp, Artificial sequence
  Synthetic nucleic acid sequence
acactccagctgggcctggaaacactgag

SEQ ID NO: 1591 - DNA, 30 bp, Artificial sequence
  Synthetic nucleic acid sequence
acactccagctgggtggtggtttacaaagt

SEQ ID NO: 1592 - DNA, 30 bp, Artificial sequence
  Synthetic nucleic acid sequence
acactccagctgggtggatttctttgtgaa

SEQ ID NO: 1593 - DNA, 30 bp, Artificial sequence
  Synthetic nucleic acid sequence
acactccagctgggaggcagcggggtgtag

SEQ ID NO: 1594 - DNA, 30 bp, Artificial sequence
  Synthetic nucleic acid sequence
acactccagctgggtccattacactaccct

SEQ ID NO: 1595 - DNA, 29 bp, Artificial sequence
  Synthetic nucleic acid sequence
acactccagctgggcgcgggtgcttactg

SEQ ID NO: 1596 - DNA, 31 bp, Artificial sequence
  Synthetic nucleic acid sequence
acactccagctgggcgggtcggagttagctc

SEQ ID NO: 1597 - DNA, 30 bp, Artificial sequence
  Synthetic nucleic acid sequence
acactccagctggggtgaacgggcgccatc

SEQ ID NO: 1598 - DNA, 29 bp, Artificial sequence
  Synthetic nucleic acid sequence
acactccagctgggtactcaaaaagctgt

SEQ ID NO: 1599 - DNA, 29 bp, Artificial sequence
  Synthetic nucleic acid sequence
acactccagctgggttaatatcggacaac

SEQ ID NO: 1600 - DNA, 29 bp, Artificial sequence
  Synthetic nucleic acid sequence
acactccagctgggtacttggaaaggcat

SEQ ID NO: 1601 - DNA, 30 bp, Artificial sequence
  Synthetic nucleic acid sequence
acactccagctgggtgcaacgaacctgagc

SEQ ID NO: 1602 - DNA, 30 bp, Artificial sequence
  Synthetic nucleic acid sequence
acactccagctgggtgcaacttacctgagt

SEQ ID NO: 1603 - DNA, 29 bp, Artificial sequence
  Synthetic nucleic acid sequence
acactccagctgggcactgtgtcctttct

SEQ ID NO: 1604 - DNA, 30 bp, Artificial sequence
  Synthetic nucleic acid sequence
acactccagctgggcactggctcctttctg

SEQ ID NO: 1605 - DNA, 28 bp, Artificial sequence
  Synthetic nucleic acid sequence
acactccagctgggggggagctgtggaa

SEQ ID NO: 1606 - DNA, 33 bp, Artificial sequence
  Synthetic nucleic acid sequence
acactccagctgggctagtgagggacagaacca

SEQ ID NO: 1607 - DNA, 31 bp, Artificial sequence
  Synthetic nucleic acid sequence
acactccagctggggcagcagagaataggac

SEQ ID NO: 1608 - DNA, 29 bp, Artificial sequence
  Synthetic nucleic acid sequence
acactccagctggggtcagcggaggaaaa

SEQ ID NO: 1609 - DNA, 28 bp, Artificial sequence
  Synthetic nucleic acid sequence
acactccagctgggagagtcttgtgatg

SEQ ID NO: 1610 - DNA, 30 bp, Artificial sequence
  Synthetic nucleic acid sequence
acactccagctgggtattgcacttgtcccg

SEQ ID NO: 1611 - DNA, 30 bp, Artificial sequence
  Synthetic nucleic acid sequence
acactccagctgggtgtgcgcagggagacc

SEQ ID NO: 1612 - DNA, 30 bp, Artificial sequence
  Synthetic nucleic acid sequence
acactccagctgggtgtctactactggaga

SEQ ID NO: 1613 - DNA, 31 bp, Artificial sequence
  Synthetic nucleic acid sequence
acactccagctgggccagttaccgcttccgc

SEQ ID NO: 1614 - DNA, 30 bp, Artificial sequence
  Synthetic nucleic acid sequence
acactccagctgggacagtagagggaggaa

SEQ ID NO: 1615 - DNA, 30 bp, Artificial sequence
  Synthetic nucleic acid sequence
acactccagctgggatccgcgctctgactc

SEQ ID NO: 1616 - DNA, 30 bp, Artificial sequence
  Synthetic nucleic acid sequence
acactccagctgggtgcccttaaaggtgaa

SEQ ID NO: 1617 - DNA, 32 bp, Artificial sequence
  Synthetic nucleic acid sequence
acactccagctgggtggggagctgaggctctg

SEQ ID NO: 1618 - DNA, 29 bp, Artificial sequence
  Synthetic nucleic acid sequence
acactccagctgggaaggcagggcccccg

SEQ ID NO: 1619 - DNA, 31 bp, Artificial sequence
  Synthetic nucleic acid sequence
acactccagctgggcacccggctgtgtgcac

SEQ ID NO: 1620 - DNA, 30 bp, Artificial sequence
  Synthetic nucleic acid sequence
acactccagctgggtcttctctgttttggc

SEQ ID NO: 1621 - DNA, 29 bp, Artificial sequence
  Synthetic nucleic acid sequence
acactccagctgggctgactgttgccgtc

SEQ ID NO: 1622 - DNA, 30 bp, Artificial sequence
  Synthetic nucleic acid sequence
acactccagctgggaaattattgtacatcg

SEQ ID NO: 1623 - DNA, 30 bp, Artificial sequence
  Synthetic nucleic acid sequence
acactccagctgggttcaacgggtatttat

SEQ ID NO: 1624 - DNA, 29 bp, Artificial sequence
  Synthetic nucleic acid sequence
acactccagctgggtacagtactgtgata

SEQ ID NO: 1625 - DNA, 31 bp, Artificial sequence
  Synthetic nucleic acid sequence
acactccagctgggccaagtgctcagatgct

SEQ ID NO: 1626 - DNA, 31 bp, Artificial sequence
  Synthetic nucleic acid sequence
acactccagctgggcaaagtgctaacagtgc

SEQ ID NO: 1627 - DNA, 30 bp, Artificial sequence
  Synthetic nucleic acid sequence
acactccagctggggagtgctggaattaaa

SEQ ID NO: 1628 - DNA, 31 bp, Artificial sequence
  Synthetic nucleic acid sequence
acactccagctgggtatgtgtgtgtgtatgt

SEQ ID NO: 1629 - DNA, 29 bp, Artificial sequence
  Synthetic nucleic acid sequence
acactccagctgggtggtgtgaggttggg

SEQ ID NO: 1630 - DNA, 30 bp, Artificial sequence
  Synthetic nucleic acid sequence
acactccagctgggtcagctgaggttcccc

SEQ ID NO: 1631 - DNA, 29 bp, Artificial sequence
  Synthetic nucleic acid sequence
acactccagctgggcagtcttactatgta

SEQ ID NO: 1632 - DNA, 30 bp, Artificial sequence
  Synthetic nucleic acid sequence
acactccagctgggaaacaaacaaacagac

SEQ ID NO: 1633 - DNA, 29 bp, Artificial sequence
  Synthetic nucleic acid sequence
acactccagctgggtaggtcacccgtttt

SEQ ID NO: 1634 - DNA, 30 bp, Artificial sequence
  Synthetic nucleic acid sequence
acactccagctggggaatgagtaactgcta

SEQ ID NO: 1635 - DNA, 31 bp, Artificial sequence
  Synthetic nucleic acid sequence
acactccagctgggtgagttcgaggccagcc

SEQ ID NO: 1636 - DNA, 28 bp, Artificial sequence
  Synthetic nucleic acid sequence
acactccagctgggaaatctacctgcct

SEQ ID NO: 1637 - DNA, 30 bp, Artificial sequence
  Synthetic nucleic acid sequence
acactccagctgggtatgtgttcctggctg

SEQ ID NO: 1638 - DNA, 28 bp, Artificial sequence
  Synthetic nucleic acid sequence
acactccagctgggtctgagtcccggtc

SEQ ID NO: 1639 - DNA, 29 bp, Artificial sequence
  Synthetic nucleic acid sequence
acactccagctggggtgaggactggggag

SEQ ID NO: 1640 - DNA, 30 bp, Artificial sequence
  Synthetic nucleic acid sequence
acactccagctgggacgggttaggctcttg

SEQ ID NO: 1641 - DNA, 29 bp, Artificial sequence
  Synthetic nucleic acid sequence
acactccagctgggcattattacttttgg

SEQ ID NO: 1642 - DNA, 29 bp, Artificial sequence
  Synthetic nucleic acid sequence
acactccagctgggtacatacttctttac

SEQ ID NO: 1643 - DNA, 30 bp, Artificial sequence
  Synthetic nucleic acid sequence
acactccagctgggactccatttgttttga

SEQ ID NO: 1644 - DNA, 30 bp, Artificial sequence
  Synthetic nucleic acid sequence
acactccagctgggtggagacgcggccctg

SEQ ID NO: 1645 - DNA, 29 bp, Artificial sequence
  Synthetic nucleic acid sequence
acactccagctgggctagactgaggctcc

SEQ ID NO: 1646 - DNA, 31 bp, Artificial sequence
  Synthetic nucleic acid sequence
acactccagctgggttaatgctaattgtgat

SEQ ID NO: 1647 - DNA, 33 bp, Artificial sequence
  Synthetic nucleic acid sequence
acactccagctgggtttggcaatggtagaactc

SEQ ID NO: 1648 - DNA, 31 bp, Artificial sequence; identical to SEQ ID NO: 1018
  Synthetic nucleic acid sequence

SEQ ID NO: 1649 - DNA, 30 bp, Artificial sequence
  Synthetic nucleic acid sequence
acactccagctgggaactggcccacaaagt

SEQ ID NO: 1650 - DNA, 30 bp, Artificial sequence
  Synthetic nucleic acid sequence
acactccagctgggtactcagtaaggcatt

SEQ ID NO: 1651 - DNA, 30 bp, Artificial sequence
  Synthetic nucleic acid sequence
acactccagctgggagaggtatagcgcatg

SEQ ID NO: 1652 - DNA, 29 bp, Artificial sequence
  Synthetic nucleic acid sequence
acactccagctgggttcctatgcatatac

SEQ ID NO: 1653 - DNA, 31 bp, Artificial sequence
  Synthetic nucleic acid sequence
acactccagctggggcttctcctggctctcc

SEQ ID NO: 1654 - DNA, 30 bp, Artificial sequence; identical to SEQ ID NO: 1038
  Synthetic nucleic acid sequence

SEQ ID NO: 1655 - DNA, 30 bp, Artificial sequence
  Synthetic nucleic acid sequence
acactccagctgggtaacagtctccagtca

SEQ ID NO: 1656 - DNA, 29 bp, Artificial sequence
  Synthetic nucleic acid sequence
acactccagctgggatgacctatgatttg

SEQ ID NO: 1657 - DNA, 31 bp, Artificial sequence; identical to SEQ ID NO: 1296
  Synthetic nucleic acid sequence

SEQ ID NO: 1658 - DNA, 29 bp, Artificial sequence
  Synthetic nucleic acid sequence
acactccagctgggccaccacagtgtcag

SEQ ID NO: 1659 - DNA, 29 bp, Artificial sequence
  Synthetic nucleic acid sequence
acactccagctgggtaagtcactagtggt

SEQ ID NO: 1660 - DNA, 32 bp, Artificial sequence
  Synthetic nucleic acid sequence
acactccagctgggaaagtgccgcctagtttt

SEQ ID NO: 1661 - DNA, 30 bp, Artificial sequence
  Synthetic nucleic acid sequence
acactccagctgggactcaaactatggggg

SEQ ID NO: 1662 - DNA, 30 bp, Artificial sequence
  Synthetic nucleic acid sequence
acactccagctgggaaagtgcttccacttt

SEQ ID NO: 1663 - DNA, 30 bp, Artificial sequence
  Synthetic nucleic acid sequence
acactccagctgggcatcaaagtggaggcc

SEQ ID NO: 1664 - DNA, 30 bp, Artificial sequence
  Synthetic nucleic acid sequence
acactccagctgggaaagtgcatccatttt

SEQ ID NO: 1665 - DNA, 30 bp, Artificial sequence
  Synthetic nucleic acid sequence
acactccagctggggatcaaagtggaggcc

SEQ ID NO: 1666 - DNA, 32 bp, Artificial sequence
  Synthetic nucleic acid sequence
acactccagctgggaaagtgccgccaggtttt

SEQ ID NO: 1667 - DNA, 30 bp, Artificial sequence
  Synthetic nucleic acid sequence
acactccagctgggactcaaactgggggct

SEQ ID NO: 1668 - DNA, 30 bp, Artificial sequence
  Synthetic nucleic acid sequence
acactccagctgggagtgccgcagagtttg

SEQ ID NO: 1669 - DNA, 30 bp, Artificial sequence
  Synthetic nucleic acid sequence
acactccagctgggaaagtgcttccctttt

SEQ ID NO: 1670 - DNA, 31 bp, Artificial sequence
  Synthetic nucleic acid sequence
acactccagctgggaaagtgctactactttt

SEQ ID NO: 1671 - DNA, 30 bp, Artificial sequence
  Synthetic nucleic acid sequence
acactccagctgggatgtatgtgtgcatgt

SEQ ID NO: 1672 - DNA, 30 bp, Artificial sequence
  Synthetic nucleic acid sequence
acactccagctgggtatacatacacacata

SEQ ID NO: 1673 - DNA, 30 bp, Artificial sequence
  Synthetic nucleic acid sequence
acactccagctgggatgtatgtgtgcatga

SEQ ID NO: 1674 - DNA, 30 bp, Artificial sequence; identical to SEQ ID NO: 1671
  Synthetic nucleic acid sequence

SEQ ID NO: 1675 - DNA, 31 bp, Artificial sequence
  Synthetic nucleic acid sequence
acactccagctgggggcagaggagggctgtt

SEQ ID NO: 1676 - DNA, 30 bp, Artificial sequence
  Synthetic nucleic acid sequence
acactccagctgggtatgtgggacggtaaa

SEQ ID NO: 1677 - DNA, 30 bp, Artificial sequence
  Synthetic nucleic acid sequence
acactccagctgggtatgcaagggcaagct

SEQ ID NO: 1678 - DNA, 31 bp, Artificial sequence
  Synthetic nucleic acid sequence
acactccagctgggcagtgcaatggtattgt

SEQ ID NO: 1679 - DNA, 30 bp, Artificial sequence
  Synthetic nucleic acid sequence
acactccagctgggaagtgcttccatgttt

SEQ ID NO: 1680 - DNA, 30 bp, Artificial sequence
  Synthetic nucleic acid sequence
acactccagctgggaggcaagatgctggca

SEQ ID NO: 1681 - DNA, 30 bp, Artificial sequence; identical to SEQ ID NO: 1347
  Synthetic nucleic acid sequence

SEQ ID NO: 1682 - DNA, 28 bp, Artificial sequence
  Synthetic nucleic acid sequence
acactccagctgggccactgccccaggt

SEQ ID NO: 1683 - DNA, 30 bp, Artificial sequence
  Synthetic nucleic acid sequence
acactccagctgggtttattgagcacctcc

SEQ ID NO: 1684 - DNA, 29 bp, Artificial sequence
  Synthetic nucleic acid sequence
acactccagctgggcctctgggcccttcc

SEQ ID NO: 1685 - DNA, 27 bp, Artificial sequence
  Synthetic nucleic acid sequence
acactccagctgggacttgaggggcat

SEQ ID NO: 1686 - DNA, 30 bp, Artificial sequence
  Synthetic nucleic acid sequence
acactccagctgggaacacacccagctaac

SEQ ID NO: 1687 - DNA, 30 bp, Artificial sequence
  Synthetic nucleic acid sequence
acactccagctgggtttttcattattgctc

SEQ ID NO: 1688 - DNA, 29 bp, Artificial sequence
  Synthetic nucleic acid sequence
acactccagctgggttcagctcctatatg

SEQ ID NO: 1689 - DNA, 29 bp, Artificial sequence
  Synthetic nucleic acid sequence
acactccagctggggaacggcgtcatgca

SEQ ID NO: 1690 - DNA, 31 bp, Artificial sequence
  Synthetic nucleic acid sequence
acactccagctgggtgagcgcctcggcgaca

SEQ ID NO: 1691 - DNA, 30 bp, Artificial sequence
  Synthetic nucleic acid sequence
acactccagctgggtccgtctcagttactt

SEQ ID NO: 1692 - DNA, 29 bp, Artificial sequence
  Synthetic nucleic acid sequence
acactccagctgggtcggtcgatcggtcg

SEQ ID NO: 1693 - DNA, 30 bp, Artificial sequence
  Synthetic nucleic acid sequence
acactccagctgggaggggtgctatctgtg

SEQ ID NO: 1694 - DNA, 28 bp, Artificial sequence
  Synthetic nucleic acid sequence
acactccagctgggtctcccttcatgtg

SEQ ID NO: 1695 - DNA, 31 bp, Artificial sequence
  Synthetic nucleic acid sequence
acactccagctgggtgatctagccaaagcct

SEQ ID NO: 1696 - DNA, 30 bp, Artificial sequence
  Synthetic nucleic acid sequence
acactccagctgggcctgaactaggggtct

SEQ ID NO: 1697 - DNA, 30 bp, Artificial sequence
  Synthetic nucleic acid sequence
acactccagctggggctgacccctagtcca

SEQ ID NO: 1698 - DNA, 31 bp, Artificial sequence
  Synthetic nucleic acid sequence
acactccagctgggtgtctgcccgagtgcct

SEQ ID NO: 1699 - DNA, 30 bp, Artificial sequence
  Synthetic nucleic acid sequence
acactccagctgggaatcactaactccact

SEQ ID NO: 1700 - DNA, 31 bp, Artificial sequence
  Synthetic nucleic acid sequence
acactccagctgggaggcagtgtaattagct

SEQ ID NO: 1701 - DNA, 30 bp, Artificial sequence
  Synthetic nucleic acid sequence
acactccagctgggttcacaaagcccatac

SEQ ID NO: 1702 - DNA, 32 bp, Artificial sequence
  Synthetic nucleic acid sequence
acactccagctgggtccctgaggagccctttg

SEQ ID NO: 1703 - DNA, 30 bp, Artificial sequence
  Synthetic nucleic acid sequence
acactccagctgggaacacacctgttcaag

SEQ ID NO: 1704 - DNA, 32 bp, Artificial sequence; identical to SEQ ID NO: 1333
  Synthetic nucleic acid sequence

SEQ ID NO: 1705 - DNA, 29 bp, Artificial sequence
  Synthetic nucleic acid sequence
acactccagctgggatcgtagaggaaaat

SEQ ID NO: 1706 - DNA, 29 bp, Artificial sequence
  Synthetic nucleic acid sequence
acactccagctgggatcatagaggaacat

SEQ ID NO: 1707 - DNA, 29 bp, Artificial sequence
  Synthetic nucleic acid sequence
acactccagctgggaacatagaggaaatt

SEQ ID NO: 1708 - DNA, 30 bp, Artificial sequence
  Synthetic nucleic acid sequence
acactccagctgggtatgtagtatggtcca

SEQ ID NO: 1709 - DNA, 30 bp, Artificial sequence
  Synthetic nucleic acid sequence
acactccagctgggatggttgaccatagaa

SEQ ID NO: 1710 - DNA, 30 bp, Artificial sequence
  Synthetic nucleic acid sequence
acactccagctgggagatcagaaggtgact

SEQ ID NO: 1711 - DNA, 30 bp, Artificial sequence
  Synthetic nucleic acid sequence
acactccagctgggattcctagaaattgtt

SEQ ID NO: 1712 - DNA, 31 bp, Artificial sequence
  Synthetic nucleic acid sequence
acactccagctgggtgtaaacaattcctagg

SEQ ID NO: 1713 - DNA, 28 bp, Artificial sequence
  Synthetic nucleic acid sequence
acactccagctgggttcacctggtccac

SEQ ID NO: 1714 - DNA, 30 bp, Artificial sequence; identical to SEQ ID NO: 1348
  Synthetic nucleic acid sequence

SEQ ID NO: 1715 - DNA, 30 bp, Artificial sequence
  Synthetic nucleic acid sequence
acactccagctgggtttgaaccatcactcg

SEQ ID NO: 1716 - DNA, 30 bp, Artificial sequence
  Synthetic nucleic acid sequence
acactccagctggggctcgactcatggttt

SEQ ID NO: 1717 - DNA, 28 bp, Artificial sequence
  Synthetic nucleic acid sequence
acactccagctgggaggcagtgttgtta

SEQ ID NO: 1718 - DNA, 29 bp, Artificial sequence
  Synthetic nucleic acid sequence
acactccagctgggaggcagtgcattgct

SEQ ID NO: 1719 - DNA, 30 bp, Artificial sequence
  Synthetic nucleic acid sequence
acactccagctgggattggggatgctttgc

SEQ ID NO: 1720 - DNA, 30 bp, Artificial sequence
  Synthetic nucleic acid sequence
acactccagctgggattgggaacattttgc

SEQ ID NO: 1721 - DNA, 30 bp, Artificial sequence
  Synthetic nucleic acid sequence
acactccagctgggttttgcagtatgttcc

SEQ ID NO: 1722 - DNA, 30 bp, Artificial sequence
  Synthetic nucleic acid sequence
acactccagctgggtgtttgcagaggaaac

SEQ ID NO: 1723 - DNA, 32 bp, Artificial sequence
  Synthetic nucleic acid sequence
acactccagctgggaggttgcctcatagtgag

SEQ ID NO: 1724 - DNA, 29 bp, Artificial sequence
  Synthetic nucleic acid sequence
acactccagctggggcagtccacgggcat

SEQ ID NO: 1725 - DNA, 30 bp, Artificial sequence
  Synthetic nucleic acid sequence
acactccagctgggtgatagacaccatata

SEQ ID NO: 1726 - DNA, 31 bp, Artificial sequence
  Synthetic nucleic acid sequence
acactccagctgggtaccaagtttattctgt

SEQ ID NO: 1727 - DNA, 30 bp, Artificial sequence
  Synthetic nucleic acid sequence
acactccagctggggatcagggcctttcta

SEQ ID NO: 1728 - DNA, 31 bp, Artificial sequence
  Synthetic nucleic acid sequence
acactccagctgggtatttagaatggcactg

SEQ ID NO: 1729 - DNA, 30 bp, Artificial sequence; identical to SEQ ID NO: 1727
  Synthetic nucleic acid sequence

SEQ ID NO: 1730 - DNA, 30 bp, Artificial sequence
  Synthetic nucleic acid sequence
acactccagctgggtatttagaatggtgct

SEQ ID NO: 1731 - DNA, 30 bp, Artificial sequence; identical to SEQ ID NO: 1727
  Synthetic nucleic acid sequence

SEQ ID NO: 1732 - DNA, 30 bp, Artificial sequence
  Synthetic nucleic acid sequence
acactccagctgggtatttagaatggcgct

SEQ ID NO: 1733 - DNA, 31 bp, Artificial sequence
  Synthetic nucleic acid sequence
acactccagctgggtatacatacacgcacac

SEQ ID NO: 1734 - DNA, 30 bp, Artificial sequence
  Synthetic nucleic acid sequence
acactccagctgggtatgtgtgtgtacatg

SEQ ID NO: 1735 - DNA, 31 bp, Artificial sequence
  Synthetic nucleic acid sequence
acactccagctgggaatacatacacgcacac

SEQ ID NO: 1736 - DNA, 31 bp, Artificial sequence; identical to SEQ ID NO: 1733
  Synthetic nucleic acid sequence

SEQ ID NO: 1737 - DNA, 30 bp, Artificial sequence
  Synthetic nucleic acid sequence
acactccagctggggatgtgtgtgtacatg

SEQ ID NO: 1738 - DNA, 31 bp, Artificial sequence; identical to SEQ ID NO: 1733
  Synthetic nucleic acid sequence

SEQ ID NO: 1739 - DNA, 30 bp, Artificial sequence
  Synthetic nucleic acid sequence
acactccagctggggatgtgtgtgtgcatg

SEQ ID NO: 1740 - DNA, 29 bp, Artificial sequence
  Synthetic nucleic acid sequence
acactccagctgggtatacatacacgcac

SEQ ID NO: 1741 - DNA, 30 bp, Artificial sequence
  Synthetic nucleic acid sequence
acactccagctgggtgtgtgtgcgtacatg

SEQ ID NO: 1742 - DNA, 31 bp, Artificial sequence; identical to SEQ ID NO: 1733
  Synthetic nucleic acid sequence

SEQ ID NO: 1743 - DNA, 30 bp, Artificial sequence; identical to SEQ ID NO: 1737
  Synthetic nucleic acid sequence

SEQ ID NO: 1744 - DNA, 30 bp, Artificial sequence
  Synthetic nucleic acid sequence
acactccagctgggacgtgtgtgtgcatgt

SEQ ID NO: 1745 - DNA, 29 bp, Artificial sequence
  Synthetic nucleic acid sequence
acactccagctgggcatacacacacacat

SEQ ID NO: 1746 - DNA, 30 bp, Artificial sequence
  Synthetic nucleic acid sequence
acactccagctgggtacgtgtgtgtgcatg

SEQ ID NO: 1747 - DNA, 29 bp, Artificial sequence
  Synthetic nucleic acid sequence
acactccagctgggatacagacacatgca

SEQ ID NO: 1748 - DNA, 30 bp, Artificial sequence
  Synthetic nucleic acid sequence
acactccagctgggtgtgtgcatgtgcttg

SEQ ID NO: 1749 - DNA, 30 bp, Artificial sequence
  Synthetic nucleic acid sequence
acactccagctgggatacacacacacatac

SEQ ID NO: 1750 - DNA, 31 bp, Artificial sequence
  Synthetic nucleic acid sequence
acactccagctgggtgtgtgcatgtgcatgt

SEQ ID NO: 1751 - DNA, 31 bp, Artificial sequence
  Synthetic nucleic acid sequence
acactccagctgggtgtgtgtgtacatgtac

SEQ ID NO: 1752 - DNA, 30 bp, Artificial sequence
  Synthetic nucleic acid sequence
acactccagctgggtataaatacatgcaca

SEQ ID NO: 1753 - DNA, 30 bp, Artificial sequence
  Synthetic nucleic acid sequence
acactccagctgggtaagtgcctgcatgta

SEQ ID NO: 1754 - DNA, 29 bp, Artificial sequence
  Synthetic nucleic acid sequence
acactccagctggggtaagtgcctgcatg

SEQ ID NO: 1755 - DNA, 30 bp, Artificial sequence
  Synthetic nucleic acid sequence
acactccagctgggtaagtgcgtgcatgta

SEQ ID NO: 1756 - DNA, 30 bp, Artificial sequence
  Synthetic nucleic acid sequence
acactccagctgggtaagtgcgcgcatgta

SEQ ID NO: 1757 - DNA, 30 bp, Artificial sequence
  Synthetic nucleic acid sequence
acactccagctgggataagtgtgagcatgt

SEQ ID NO: 1758 - DNA, 29 bp, Artificial sequence
  Synthetic nucleic acid sequence
acactccagctgggatatacacacacaca

SEQ ID NO: 1759 - DNA, 29 bp, Artificial sequence
  Synthetic nucleic acid sequence
acactccagctgggtatacatacacacac

SEQ ID NO: 1760 - DNA, 30 bp, Artificial sequence
  Synthetic nucleic acid sequence
acactccagctgggataagtgtgtgcatgt

SEQ ID NO: 1761 - DNA, 31 bp, Artificial sequence
  Synthetic nucleic acid sequence
acactccagctgggtatgactgatgtgcgtg

SEQ ID NO: 1762 - DNA, 34 bp, Artificial sequence
  Synthetic nucleic acid sequence
acactccagctgggtgcctctttcattgatcttg

SEQ ID NO: 1763 - DNA, 31 bp, Artificial sequence
  Synthetic nucleic acid sequence
acactccagctgggttcttggactggcactg

SEQ ID NO: 1764 - DNA, 30 bp, Artificial sequence
  Synthetic nucleic acid sequence
acactccagctgggtacgtagtatagtgct

SEQ ID NO: 1765 - DNA, 30 bp, Artificial sequence
  Synthetic nucleic acid sequence
acactccagctgggaagacgggagaagaga

SEQ ID NO: 1766 - DNA, 29 bp, Artificial sequence
  Synthetic nucleic acid sequence
acactccagctgggttgaaaggctgtttc

SEQ ID NO: 1767 - DNA, 31 bp, Artificial sequence
  Synthetic nucleic acid sequence
acactccagctgggaatgacaccacatatat

SEQ ID NO: 1768 - DNA, 31 bp, Artificial sequence
  Synthetic nucleic acid sequence
acactccagctgggtgaaggtcctactgtgt

SEQ ID NO: 1769 - DNA, 30 bp, Artificial sequence
  Synthetic nucleic acid sequence
acactccagctgggcagcagcacactgtgg

SEQ ID NO: 1770 - DNA, 30 bp, Artificial sequence; identical to SEQ ID NO: 1375
  Synthetic nucleic acid sequence

SEQ ID NO: 1771 - DNA, 30 bp, Artificial sequence; identical to SEQ ID NO: 1373
  Synthetic nucleic acid sequence

SEQ ID NO: 1772 - DNA, 30 bp, Artificial sequence; identical to SEQ ID NO: 1374
  Synthetic nucleic acid sequence

SEQ ID NO: 1773 - DNA, 31 bp, Artificial sequence
  Synthetic nucleic acid sequence
acactccagctgggtagcagcgggaacagta

SEQ ID NO: 1774 - DNA, 30 bp, Artificial sequence; identical to SEQ ID NO: 1378
  Synthetic nucleic acid sequence

SEQ ID NO: 1775 - DNA, 29 bp, Artificial sequence
  Synthetic nucleic acid sequence
acactccagctgggtgattgacatttctg

SEQ ID NO: 1776 - DNA, 30 bp, Artificial sequence
  Synthetic nucleic acid sequence
acactccagctgggtactccagaatgtggc

SEQ ID NO: 1777 - DNA, 29 bp, Artificial sequence
  Synthetic nucleic acid sequence
acactccagctgggatgccttttgctctg

SEQ ID NO: 1778 - DNA, 28 bp, Artificial sequence
  Synthetic nucleic acid sequence
acactccagctgggaggtcagaggtcga

SEQ ID NO: 1779 - DNA, 31 bp, Artificial sequence
  Synthetic nucleic acid sequence
acactccagctgggcaagggtcaccctctga

SEQ ID NO: 1780 - DNA, 33 bp, Artificial sequence
  Synthetic nucleic acid sequence
acactccagctgggaagggattctgatgttggt

SEQ ID NO: 1781 - DNA, 30 bp, Artificial sequence
  Synthetic nucleic acid sequence
acactccagctgggctcggggatcatcatg

SEQ ID NO: 1782 - DNA, 30 bp, Artificial sequence; identical to SEQ ID NO: 1441
  Synthetic nucleic acid sequence

SEQ ID NO: 1783 - DNA, 24 bp, Artificial sequence
  Synthetic nucleic acid sequence
acactccagctgggatggtggcac

SEQ ID NO: 1784 - DNA, 29 bp, Artificial sequence
  Synthetic nucleic acid sequence
acactccagctgggcttggtacatctttg

SEQ ID NO: 1785 - DNA, 30 bp, Artificial sequence
  Synthetic nucleic acid sequence
acactccagctgggcctgttgaacaactga

SEQ ID NO: 1786 - DNA, 30 bp, Artificial sequence
  Synthetic nucleic acid sequence
acactccagctgggtacagttgttcaacca

SEQ ID NO: 1787 - DNA, 31 bp, Artificial sequence
  Synthetic nucleic acid sequence
acactccagctgggattgtgtcaatatgcga

SEQ ID NO: 1788 - DNA, 30 bp, Artificial sequence
  Synthetic nucleic acid sequence
acactccagctgggtacgtcatcgtcgtca

SEQ ID NO: 1789 - DNA, 30 bp, Artificial sequence
  Synthetic nucleic acid sequence
acactccagctgggtggtaagctgcagaac

SEQ ID NO: 1790 - DNA, 28 bp, Artificial sequence
  Synthetic nucleic acid sequence
acactccagctgggaccaggaggctgag

SEQ ID NO: 1791 - DNA, 30 bp, Artificial sequence
  Synthetic nucleic acid sequence
acactccagctgggggctgcagcgtgatcg

SEQ ID NO: 1792 - DNA, 30 bp, Artificial sequence
  Synthetic nucleic acid sequence
acactccagctgggagcgggcacagctgtg

SEQ ID NO: 1793 - DNA, 31 bp, Artificial sequence
  Synthetic nucleic acid sequence
acactccagctgggtgacacctgccacccag

SEQ ID NO: 1794 - DNA, 32 bp, Artificial sequence
  Synthetic nucleic acid sequence
acactccagctgggtgtcactcggctcggccc

SEQ ID NO: 1795 - DNA, 30 bp, Artificial sequence
  Synthetic nucleic acid sequence
acactccagctgggagttgtgtgtgcatgt

SEQ ID NO: 1796 - DNA, 30 bp, Artificial sequence
  Synthetic nucleic acid sequence
acactccagctgggagttttgtgtgcatgt

SEQ ID NO: 1797 - DNA, 30 bp, Artificial sequence
  Synthetic nucleic acid sequence
acactccagctgggatagttgtgtgtggat

SEQ ID NO: 1798 - DNA, 30 bp, Artificial sequence
  Synthetic nucleic acid sequence
acactccagctgggacttgtgtgtgcatgt

SEQ ID NO: 1799 - DNA, 30 bp, Artificial sequence
  Synthetic nucleic acid sequence
acactccagctgggtgtcttgtgtgtgcat

SEQ ID NO: 1800 - DNA, 31 bp, Artificial sequence
  Synthetic nucleic acid sequence
acactccagctgggcatatacatacacacac

SEQ ID NO: 1801 - DNA, 31 bp, Artificial sequence
  Synthetic nucleic acid sequence
acactccagctgggtgcattgtatgtgttga

SEQ ID NO: 1802 - DNA, 30 bp, Artificial sequence
  Synthetic nucleic acid sequence
acactccagctgggtatgcatatacacaca

SEQ ID NO: 1803 - DNA, 32 bp, Artificial sequence
  Synthetic nucleic acid sequence
acactccagctgggatgcatgggtgtatagtt

SEQ ID NO: 1804 - DNA, 29 bp, Artificial sequence
  Synthetic nucleic acid sequence
acactccagctgggtgcatatacacacat

SEQ ID NO: 1805 - DNA, 30 bp, Artificial sequence
  Synthetic nucleic acid sequence
acactccagctgggtgcatatactcacatg

SEQ ID NO: 1806 - DNA, 29 bp, Artificial sequence
  Synthetic nucleic acid sequence
acactccagctgggtatgcatatacacgc

SEQ ID NO: 1807 - DNA, 30 bp, Artificial sequence
  Synthetic nucleic acid sequence
acactccagctgggatccctgagtgtatgt

SEQ ID NO: 1808 - DNA, 31 bp, Artificial sequence
  Synthetic nucleic acid sequence
acactccagctgggtgaggttggtgtactgt

SEQ ID NO: 1809 - DNA, 31 bp, Artificial sequence
  Synthetic nucleic acid sequence
acactccagctgggtccggggctgagttctg

SEQ ID NO: 1810 - DNA, 30 bp, Artificial sequence
  Synthetic nucleic acid sequence
acactccagctgggctcacagctctggtcc

SEQ ID NO: 1811 - DNA, 30 bp, Artificial sequence
  Synthetic nucleic acid sequence
acactccagctggggcactgagatgggagt

SEQ ID NO: 1812 - DNA, 30 bp, Artificial sequence
  Synthetic nucleic acid sequence
acactccagctgggctgtatgccctaaccg

SEQ ID NO: 1813 - DNA, 30 bp, Artificial sequence
  Synthetic nucleic acid sequence
acactccagctgggtggtgcggaaagggcc

SEQ ID NO: 1814 - DNA, 29 bp, Artificial sequence
  Synthetic nucleic acid sequence
acactccagctgggccgtcctgaggttgt

SEQ ID NO: 1815 - DNA, 30 bp, Artificial sequence
  Synthetic nucleic acid sequence
acactccagctgggttcagtgatgattagc

SEQ ID NO: 1816 - DNA, 30 bp, Artificial sequence
  Synthetic nucleic acid sequence
acactccagctggggtctcggtgcaaggac

SEQ ID NO: 1817 - DNA, 30 bp, Artificial sequence
  Synthetic nucleic acid sequence
acactccagctgggggactgtgaggtgact

SEQ ID NO: 1818 - DNA, 29 bp, Artificial sequence
  Synthetic nucleic acid sequence
acactccagctggggggcatctgctgaca

SEQ ID NO: 1819 - DNA, 29 bp, Artificial sequence
  Synthetic nucleic acid sequence
acactccagctgggcagcctcgctggcag

SEQ ID NO: 1820 - DNA, 29 bp, Artificial sequence
  Synthetic nucleic acid sequence
acactccagctgggctgcagtcacagtga

SEQ ID NO: 1821 - DNA, 29 bp, Artificial sequence
  Synthetic nucleic acid sequence
acactccagctgggcctgctgtaagctgt

SEQ ID NO: 1822 - DNA, 27 bp, Artificial sequence
  Synthetic nucleic acid sequence
acactccagctgggagttttcccttca

SEQ ID NO: 1823 - DNA, 29 bp, Artificial sequence
  Synthetic nucleic acid sequence
acactccagctgggtcaatggctgaggtg

SEQ ID NO: 1824 - DNA, 30 bp, Artificial sequence
  Synthetic nucleic acid sequence
acactccagctgggattgcttcccagacgg

SEQ ID NO: 1825 - DNA, 30 bp, Artificial sequence
  Synthetic nucleic acid sequence
acactccagctgggctatcctggaatgcag

SEQ ID NO: 1826 - DNA, 28 bp, Artificial sequence
  Synthetic nucleic acid sequence
acactccagctgggtcgcaggcgactac

SEQ ID NO: 1827 - DNA, 29 bp, Artificial sequence
  Synthetic nucleic acid sequence
acactccagctgggcgtccccgctcggcg

SEQ ID NO: 1828 - DNA, 30 bp, Artificial sequence
  Synthetic nucleic acid sequence
acactccagctgggaaaggctaggctcaca

SEQ ID NO: 1829 - DNA, 30 bp, Artificial sequence
  Synthetic nucleic acid sequence
acactccagctgggattcctgaagagaggc

SEQ ID NO: 1830 - DNA, 29 bp, Artificial sequence
  Synthetic nucleic acid sequence
acactccagctgggatctctttgagcgcc

SEQ ID NO: 1831 - DNA, 31 bp, Artificial sequence
  Synthetic nucleic acid sequence
acactccagctggggcagctttcagatgtgg

SEQ ID NO: 1832 - DNA, 29 bp, Artificial sequence
  Synthetic nucleic acid sequence
acactccagctgggcagccacatccgaaa

SEQ ID NO: 1833 - DNA, 27 bp, Artificial sequence
  Synthetic nucleic acid sequence
acactccagctgggctgaaaatgttgc

SEQ ID NO: 1834 - DNA, 30 bp, Artificial sequence
  Synthetic nucleic acid sequence
acactccagctgggagattgggcataggtg

SEQ ID NO: 1835 - DNA, 26 bp, Artificial sequence
  Synthetic nucleic acid sequence
acactccagctggggcgtgtgcttgc

SEQ ID NO: 1836 - DNA, 29 bp, Artificial sequence
  Synthetic nucleic acid sequence
acactccagctgggaacatcctggtcctg

SEQ ID NO: 1837 - DNA, 27 bp, Artificial sequence
  Synthetic nucleic acid sequence
acactccagctgggcattctcgtttcc

SEQ ID NO: 1838 - DNA, 28 bp, Artificial sequence
  Synthetic nucleic acid sequence
acactccagctgggaggcagtgcgacct

SEQ ID NO: 1839 - DNA, 29 bp, Artificial sequence
  Synthetic nucleic acid sequence
acactccagctgggcacgcgggaaccgag

SEQ ID NO: 1840 - DNA, 29 bp, Artificial sequence
  Synthetic nucleic acid sequence
acactccagctgggttagccgctgaaata

SEQ ID NO: 1841 - DNA, 29 bp, Artificial sequence
  Synthetic nucleic acid sequence
acactccagctgggtgcccaccctttacc

SEQ ID NO: 1842 - DNA, 29 bp, Artificial sequence
  Synthetic nucleic acid sequence
acactccagctgggaaaaccttcagaagg

SEQ ID NO: 1843 - DNA, 29 bp, Artificial sequence
  Synthetic nucleic acid sequence
acactccagctgggagacatgtgctctgc

SEQ ID NO: 1844 - DNA, 28 bp, Artificial sequence
  Synthetic nucleic acid sequence
acactccagctgggggtgggaggtgggg

SEQ ID NO: 1845 - DNA, 30 bp, Artificial sequence
  Synthetic nucleic acid sequence
acactccagctgggagagaaaccctgtctc

SEQ ID NO: 1846 - DNA, 29 bp, Artificial sequence
  Synthetic nucleic acid sequence
acactccagctgggcagtcatgccgcttg

SEQ ID NO: 1847 - DNA, 27 bp, Artificial sequence
  Synthetic nucleic acid sequence
acactccagctgggggaggcagaggca

SEQ ID NO: 1848 - DNA, 30 bp, Artificial sequence
  Synthetic nucleic acid sequence
acactccagctgggccaagtcttggggaga

SEQ ID NO: 1849 - DNA, 30 bp, Artificial sequence
  Synthetic nucleic acid sequence
acactccagctggggggacccggggagaga

SEQ ID NO: 1850 - DNA, 29 bp, Artificial sequence
  Synthetic nucleic acid sequence
acactccagctgggctccttcacccgggc

SEQ ID NO: 1851 - DNA, 27 bp, Artificial sequence
  Synthetic nucleic acid sequence
acactccagctgggtgcactgaaggca

SEQ ID NO: 1852 - DNA, 29 bp, Artificial sequence
  Synthetic nucleic acid sequence
acactccagctgggcgacgagggccggtc

SEQ ID NO: 1853 - DNA, 29 bp, Artificial sequence
  Synthetic nucleic acid sequence
acactccagctgggctccgtgcacacccc

SEQ ID NO: 1854 - DNA, 30 bp, Artificial sequence
  Synthetic nucleic acid sequence
acactccagctgggctcagacagagatacc

SEQ ID NO: 1855 - DNA, 29 bp, Artificial sequence
  Synthetic nucleic acid sequence
acactccagctgggcttccgcccggccgg

SEQ ID NO: 1856 - DNA, 30 bp, Artificial sequence
  Synthetic nucleic acid sequence
acactccagctgggatctcggctacagaaa

SEQ ID NO: 1857 - DNA, 26 bp, Artificial sequence
  Synthetic nucleic acid sequence
acactccagctgggatctcgctgggg

SEQ ID NO: 1858 - DNA, 29 bp, Artificial sequence
  Synthetic nucleic acid sequence
acactccagctgggcagtgcaattaaaag

SEQ ID NO: 1859 - DNA, 31 bp, Artificial sequence
  Synthetic nucleic acid sequence
acactccagctgggtgagagatgccattcta

SEQ ID NO: 1860 - DNA, 30 bp, Artificial sequence
  Synthetic nucleic acid sequence
acactccagctggggaaagccaccatgctg

SEQ ID NO: 1861 - DNA, 30 bp, Artificial sequence
  Synthetic nucleic acid sequence
acactccagctggggaaagacaccaagctg

SEQ ID NO: 1862 - DNA, 30 bp, Artificial sequence
  Synthetic nucleic acid sequence
acactccagctggggaaagacatcatgctg

SEQ ID NO: 1863 - DNA, 29 bp, Artificial sequence
  Synthetic nucleic acid sequence
acactccagctgggtgttcagactggtgt

SEQ ID NO: 1864 - DNA, 27 bp, Artificial sequence
  Synthetic nucleic acid sequence
acactccagctgggtttgtgacctggt

SEQ ID NO: 1865 - DNA, 30 bp, Artificial sequence
  Synthetic nucleic acid sequence
acactccagctggggcagagtgcaaacaat

SEQ ID NO: 1866 - DNA, 30 bp, Artificial sequence
  Synthetic nucleic acid sequence
acactccagctggggcagcagggtgaaact

SEQ ID NO: 1867 - DNA, 30 bp, Artificial sequence
  Synthetic nucleic acid sequence
acactccagctgggggggctggggccggga

SEQ ID NO: 1868 - DNA, 30 bp, Artificial sequence
  Synthetic nucleic acid sequence
acactccagctgggccagctgggaagaacc

SEQ ID NO: 1869 - DNA, 30 bp, Artificial sequence
  Synthetic nucleic acid sequence
acactccagctgggaggaggccatagtggc

SEQ ID NO: 1870 - DNA, 27 bp, Artificial sequence
  Synthetic nucleic acid sequence
acactccagctgggggtgctcacatgt

SEQ ID NO: 1871 - DNA, 30 bp, Artificial sequence
  Synthetic nucleic acid sequence
acactccagctgggcgtgggcctgacgtgg

SEQ ID NO: 1872 - DNA, 30 bp, Artificial sequence
  Synthetic nucleic acid sequence
acactccagctgggagcaccacgtgtctgg

SEQ ID NO: 1873 - DNA, 31 bp, Artificial sequence
  Synthetic nucleic acid sequence
acactccagctgggtggaagacttgtgattt

SEQ ID NO: 1874 - DNA, 30 bp, Artificial sequence
  Synthetic nucleic acid sequence
acactccagctgggtcagtaacaaagattc

SEQ ID NO: 1875 - DNA, 30 bp, Artificial sequence
  Synthetic nucleic acid sequence
acactccagctgggtgtgagttgttcctca

SEQ ID NO: 1876 - DNA, 28 bp, Artificial sequence
  Synthetic nucleic acid sequence
acactccagctggggaattgatcaggac

SEQ ID NO: 1877 - DNA, 31 bp, Artificial sequence
  Synthetic nucleic acid sequence
acactccagctgggtattcagattagtgcca

SEQ ID NO: 1878 - DNA, 29 bp, Artificial sequence
  Synthetic nucleic acid sequence
acactccagctgggaaggttacttgttag

SEQ ID NO: 1879 - DNA, 29 bp, Artificial sequence
  Synthetic nucleic acid sequence
acactccagctgggcctgaaaatactgag

SEQ ID NO: 1880 - DNA, 30 bp, Artificial sequence
  Synthetic nucleic acid sequence
acactccagctgggtagtggtttacaaagt

SEQ ID NO: 1881 - DNA, 30 bp, Artificial sequence
  Synthetic nucleic acid sequence
acactccagctgggtggatttctctgtgaa

SEQ ID NO: 1882 - DNA, 30 bp, Artificial sequence
  Synthetic nucleic acid sequence
acactccagctggggcatgacaccacactg

SEQ ID NO: 1883 - DNA, 30 bp, Artificial sequence
  Synthetic nucleic acid sequence
acactccagctgggtatctagttggatgtc

SEQ ID NO: 1884 - DNA, 29 bp, Artificial sequence
  Synthetic nucleic acid sequence
acactccagctgggagaggcttatagctc

SEQ ID NO: 1885 - DNA, 30 bp, Artificial sequence
  Synthetic nucleic acid sequence
acactccagctgggtactccatcctctctg

SEQ ID NO: 1886 - DNA, 30 bp, Artificial sequence
  Synthetic nucleic acid sequence
acactccagctgggaactgtgtcttttctg

SEQ ID NO: 1887 - DNA, 30 bp, Artificial sequence
  Synthetic nucleic acid sequence
acactccagctgggaggagagagttagcgc

SEQ ID NO: 1888 - DNA, 30 bp, Artificial sequence
  Synthetic nucleic acid sequence
acactccagctgggtaactgcaacagctct

SEQ ID NO: 1889 - DNA, 30 bp, Artificial sequence
  Synthetic nucleic acid sequence
acactccagctgggtgctgagagaagtagc

SEQ ID NO: 1890 - DNA, 30 bp, Artificial sequence
  Synthetic nucleic acid sequence
acactccagctgggtaactgcaacatctct

SEQ ID NO: 1891 - DNA, 30 bp, Artificial sequence
  Synthetic nucleic acid sequence
acactccagctgggtactgagaatgggtag

SEQ ID NO: 1892 - DNA, 29 bp, Artificial sequence
  Synthetic nucleic acid sequence
acactccagctgggtattgcacttgtccc

SEQ ID NO: 1893 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagaactatac

SEQ ID NO: 1894 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagaaccacac

SEQ ID NO: 1895 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagaaccatac

SEQ ID NO: 1896 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagaactatgc

SEQ ID NO: 1897 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagaactatac

SEQ ID NO: 1898 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagaactatac

SEQ ID NO: 1899 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagaactgtac

SEQ ID NO: 1900 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagaacagcac

SEQ ID NO: 1901 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagatacatac

SEQ ID NO: 1902 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagcacaagtt

SEQ ID NO: 1903 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagttcagtta

SEQ ID NO: 1904 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtcatagcc

SEQ ID NO: 1905 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagatctgcac

SEQ ID NO: 1906 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtgatagcc

SEQ ID NO: 1907 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagcacaaatt

SEQ ID NO: 1908 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagcacaaatt

SEQ ID NO: 1909 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagagaagtag

SEQ ID NO: 1910 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagcaaacacc

SEQ ID NO: 1911 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagggcattca

SEQ ID NO: 1912 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagggctccca

SEQ ID NO: 1913 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtcacaggt

SEQ ID NO: 1914 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtcacaagt

SEQ ID NO: 1915 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagcgcattat

SEQ ID NO: 1916 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagagccaagc

SEQ ID NO: 1917 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagaaagagac

SEQ ID NO: 1918 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagatgctttt

SEQ ID NO: 1919 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgaggcaagccc

SEQ ID NO: 1920 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagatgccctt

SEQ ID NO: 1921 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagatgccctt

SEQ ID NO: 1922 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagcgaccatg

SEQ ID NO: 1923 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagcagctggt

SEQ ID NO: 1924 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtagctggt

SEQ ID NO: 1925 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagcccctctg

SEQ ID NO: 1926 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtcacatag

SEQ ID NO: 1927 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtcacatag

SEQ ID NO: 1928 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagctacgcgt

SEQ ID NO: 1929 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagcggcctga

SEQ ID NO: 1930 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagctggagac

SEQ ID NO: 1931 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagctaccata

SEQ ID NO: 1932 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagccatcttt

SEQ ID NO: 1933 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtccataaa

SEQ ID NO: 1934 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagagtagtgc

SEQ ID NO: 1935 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgaggagctaca

SEQ ID NO: 1936 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagagtacatc

SEQ ID NO: 1937 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagagggattc

SEQ ID NO: 1938 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagaacccatg

SEQ ID NO: 1939 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagagcctatg

SEQ ID NO: 1940 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtagcagaa

SEQ ID NO: 1941 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagacaaagtt

SEQ ID NO: 1942 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagacaaagtt

SEQ ID NO: 1943 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgaggggagtga

SEQ ID NO: 1944 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagcactggta

SEQ ID NO: 1945 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagactagact

SEQ ID NO: 1946 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagccaagttc

SEQ ID NO: 1947 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgaggatcactt

SEQ ID NO: 1948 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagcgaaggca

SEQ ID NO: 1949 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagcacaaacc

SEQ ID NO: 1950 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtgtaaacc

SEQ ID NO: 1951 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagcgccaata

SEQ ID NO: 1952 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagctacctgc

SEQ ID NO: 1953 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagactcaccg

SEQ ID NO: 1954 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagacccaccg

SEQ ID NO: 1955 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagactcaccg

SEQ ID NO: 1956 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagacccaccg

SEQ ID NO: 1957 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagagtgaatt

SEQ ID NO: 1958 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagacccttat

SEQ ID NO: 1959 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtcaggaac

SEQ ID NO: 1960 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagagcccaaa

SEQ ID NO: 1961 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagccggctgc

SEQ ID NO: 1962 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtgcaaacc

SEQ ID NO: 1963 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagccctccac

SEQ ID NO: 1964 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagctatctgc

SEQ ID NO: 1965 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagacctaata

SEQ ID NO: 1966 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagaacccaat

SEQ ID NO: 1967 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagcagctgct

SEQ ID NO: 1968 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagggctgtca

SEQ ID NO: 1969 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagactgggac

SEQ ID NO: 1970 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtccacatg

SEQ ID NO: 1971 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgaggccaatat

SEQ ID NO: 1972 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagcccaacaa

SEQ ID NO: 1973 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagcccaacaa

SEQ ID NO: 1974 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgaggctgggtg

SEQ ID NO: 1975 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgaggaacaggt

SEQ ID NO: 1976 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtaaccaat

SEQ ID NO: 1977 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtaaccaat

SEQ ID NO: 1978 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtcagtttt

SEQ ID NO: 1979 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtcagtttt

SEQ ID NO: 1980 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagacatcgtt

SEQ ID NO: 1981 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtcatcatt

SEQ ID NO: 1982 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtccatcat

SEQ ID NO: 1983 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagctagtggt

SEQ ID NO: 1984 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagaggcatag

SEQ ID NO: 1985 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagcagactcc

SEQ ID NO: 1986 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagccacacac

SEQ ID NO: 1987 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagacaagctt

SEQ ID NO: 1988 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagacaaacct

SEQ ID NO: 1989 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagctacctgc

SEQ ID NO: 1990 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagctacctgc

SEQ ID NO: 1991 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtcaacatc

SEQ ID NO: 1992 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtcagccgc

SEQ ID NO: 1993 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagactgcctg

SEQ ID NO: 1994 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtcacagtt

SEQ ID NO: 1995 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtcacattt

SEQ ID NO: 1996 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagacatggtt

SEQ ID NO: 1997 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagagaattgc

SEQ ID NO: 1998 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagacagttct

SEQ ID NO: 1999 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgaggaaaccca

SEQ ID NO: 2000 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagacccagta

SEQ ID NO: 2001 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtggggtat

SEQ ID NO: 2002 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagggaaatcc

SEQ ID NO: 2003 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagggtaatcc

SEQ ID NO: 2004 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagctgttcct

SEQ ID NO: 2005 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtcagaccg

SEQ ID NO: 2006 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagagcctatc

SEQ ID NO: 2007 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagacctatcc

SEQ ID NO: 2008 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgaggcggaact

SEQ ID NO: 2009 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgaggcagaact

SEQ ID NO: 2010 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagctcaatag

SEQ ID NO: 2011 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagggagagcc

SEQ ID NO: 2012 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagacaggatt

SEQ ID NO: 2013 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtaaccgat

SEQ ID NO: 2014 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagaacactga

SEQ ID NO: 2015 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtaaccgat

SEQ ID NO: 2016 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgaggctttgac

SEQ ID NO: 2017 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtcaccaaa

SEQ ID NO: 2018 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagctactaaa

SEQ ID NO: 2019 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagacactcaa

SEQ ID NO: 2020 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagcttccagt

SEQ ID NO: 2021 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagagctgagt

SEQ ID NO: 2022 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgaggctgagag

SEQ ID NO: 2023 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagcttccagt

SEQ ID NO: 2024 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagcttccagt

SEQ ID NO: 2025 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtgcaactt

SEQ ID NO: 2026 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtcgccctc

SEQ ID NO: 2027 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagagaggtcg

SEQ ID NO: 2028 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgaggcgaacgc

SEQ ID NO: 2029 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagacaccaat

SEQ ID NO: 2030 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagacggaagg

SEQ ID NO: 2031 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtgcaatgc

SEQ ID NO: 2032 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgaggcctaaga

SEQ ID NO: 2033 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagttctagga

SEQ ID NO: 2034 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagggatccct

SEQ ID NO: 2035 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagacattttt

SEQ ID NO: 2036 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagcaacaaaa

SEQ ID NO: 2037 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagcactcagc

SEQ ID NO: 2038 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagcgtgagct

SEQ ID NO: 2039 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagaatcagtc

SEQ ID NO: 2040 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagacgggtgc

SEQ ID NO: 2041 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagacaaccag

SEQ ID NO: 2042 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgaggcaatcag

SEQ ID NO: 2043 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgaggtacccct

SEQ ID NO: 2044 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtacagatg

SEQ ID NO: 2045 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagataaggat

SEQ ID NO: 2046 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtcaccatt

SEQ ID NO: 2047 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagaaagatca

SEQ ID NO: 2048 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgaggcgaatat

SEQ ID NO: 2049 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagaccaggtt

SEQ ID NO: 2050 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagcacttagc

SEQ ID NO: 2051 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtcacgcga

SEQ ID NO: 2052 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagacaaaagt

SEQ ID NO: 2053 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagccttctga

SEQ ID NO: 2054 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagcctacgtt

SEQ ID NO: 2055 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagacagagag

SEQ ID NO: 2056 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagcgaatcca

SEQ ID NO: 2057 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagaggggttc

SEQ ID NO: 2058 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagatgcaaag

SEQ ID NO: 2059 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagacaggcca

SEQ ID NO: 2060 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagcgtacgct

SEQ ID NO: 2061 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgaggcgcccaa

SEQ ID NO: 2062 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagactgaggg

SEQ ID NO: 2063 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagaaagtctc

SEQ ID NO: 2064 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtcaacggg

SEQ ID NO: 2065 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtgcatgac

SEQ ID NO: 2066 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagacaccgag

SEQ ID NO: 2067 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagatgggaca

SEQ ID NO: 2068 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagaccagcta

SEQ ID NO: 2069 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagatattagg

SEQ ID NO: 2070 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagaactcagt

SEQ ID NO: 2071 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagatcgggag

SEQ ID NO: 2072 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgaggaattcat

SEQ ID NO: 2073 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagctcggggc

SEQ ID NO: 2074 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagaagtggat

SEQ ID NO: 2075 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagcagcatgg

SEQ ID NO: 2076 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagcctcatgg

SEQ ID NO: 2077 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgaggaggtttc

SEQ ID NO: 2078 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagaagaagtg

SEQ ID NO: 2079 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgaggagattgg

SEQ ID NO: 2080 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagaaacatca

SEQ ID NO: 2081 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgaggatagagt

SEQ ID NO: 2082 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtgcaagcc

SEQ ID NO: 2083 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagacggtcct

SEQ ID NO: 2084 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagacacacca

SEQ ID NO: 2085 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtttcagtt

SEQ ID NO: 2086 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagaagaagtg

SEQ ID NO: 2087 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagctgaaacc

SEQ ID NO: 2088 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgaggtgtgtat

SEQ ID NO: 2089 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtgtgggtg

SEQ ID NO: 2090 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagacacactc

SEQ ID NO: 2091 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagactagctt

SEQ ID NO: 2092 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagctgcactt

SEQ ID NO: 2093 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagaagaggga

SEQ ID NO: 2094 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgaggatccgag

SEQ ID NO: 2095 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagcacaaccc

SEQ ID NO: 2096 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagcagtagag

SEQ ID NO: 2097 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagaaggtgat

SEQ ID NO: 2098 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagggtggagc

SEQ ID NO: 2099 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagctccagcc

SEQ ID NO: 2100 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagcccagcta

SEQ ID NO: 2101 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtgctgtta

SEQ ID NO: 2102 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtccccaca

SEQ ID NO: 2103 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagacaacaaa

SEQ ID NO: 2104 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagaggagact

SEQ ID NO: 2105 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtcggtccc

SEQ ID NO: 2106 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagcacctgat

SEQ ID NO: 2107 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagccctgcgc

SEQ ID NO: 2108 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtcatacag

SEQ ID NO: 2109 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagggaggccg

SEQ ID NO: 2110 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagctacctgc

SEQ ID NO: 2111 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagagcaaaaa

SEQ ID NO: 2112 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagaacaatac

SEQ ID NO: 2113 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagcacaagat

SEQ ID NO: 2114 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagcgcaaggt

SEQ ID NO: 2115 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagaccacagg

SEQ ID NO: 2116 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagctacctgc

SEQ ID NO: 2117 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagctagggaa

SEQ ID NO: 2118 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagccaaccaa

SEQ ID NO: 2119 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagacacaccc

SEQ ID NO: 2120 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagcggctcgg

SEQ ID NO: 2121 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgaggtcacatc

SEQ ID NO: 2122 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtgcccact

SEQ ID NO: 2123 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagggaagcca

SEQ ID NO: 2124 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagaacataca

SEQ ID NO: 2125 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgaggaggctca

SEQ ID NO: 2126 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtcagagca

SEQ ID NO: 2127 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagctccccca

SEQ ID NO: 2128 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgaggagctgca

SEQ ID NO: 2129 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagataatgga

SEQ ID NO: 2130 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagctcaaagc

SEQ ID NO: 2131 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgaggcttaaac

SEQ ID NO: 2132 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgaggaaatgag

SEQ ID NO: 2133 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagcccctccc

SEQ ID NO: 2134 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtccgcctg

SEQ ID NO: 2135 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagctgaggag

SEQ ID NO: 2136 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagccacctcc

SEQ ID NO: 2137 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagctgggggc

SEQ ID NO: 2138 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagccccccac

SEQ ID NO: 2139 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagctagggaa

SEQ ID NO: 2140 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagctggggaa

SEQ ID NO: 2141 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagggggggcg

SEQ ID NO: 2142 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagctgtggga

SEQ ID NO: 2143 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgaggcagctgt

SEQ ID NO: 2144 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagctgcggga

SEQ ID NO: 2145 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgaggtggggtg

SEQ ID NO: 2146 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagctggagag

SEQ ID NO: 2147 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagctggggga

SEQ ID NO: 2148 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagggggcaga

SEQ ID NO: 2149 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagcactccta

SEQ ID NO: 2150 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagaaccatct

SEQ ID NO: 2151 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagatgtaggc

SEQ ID NO: 2152 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagcctgctcc

SEQ ID NO: 2153 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtccgggga

SEQ ID NO: 2154 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtttagcac

SEQ ID NO: 2155 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtgaagaag

SEQ ID NO: 2156 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagaaaggcca

SEQ ID NO: 2157 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagagcgcctt

SEQ ID NO: 2158 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtaaatgaa

SEQ ID NO: 2159 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtgcaggct

SEQ ID NO: 2160 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagactgcagg

SEQ ID NO: 2161 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagaatctact

SEQ ID NO: 2162 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagaaccactt

SEQ ID NO: 2163 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagagctagtg

SEQ ID NO: 2164 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagggtcagaa

SEQ ID NO: 2165 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagttccacga

SEQ ID NO: 2166 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagaaaagcta

SEQ ID NO: 2167 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtggtggca

SEQ ID NO: 2168 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagaagccaaa

SEQ ID NO: 2169 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagatccttct

SEQ ID NO: 2170 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagactcagta

SEQ ID NO: 2171 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagaacaggtg

SEQ ID NO: 2172 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagaacaacac

SEQ ID NO: 2173 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagagccctgt

SEQ ID NO: 2174 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtggggatt

SEQ ID NO: 2175 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagcccccacc

SEQ ID NO: 2176 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagccagtagc

SEQ ID NO: 2177 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagacacagct

SEQ ID NO: 2178 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtgagtgct

SEQ ID NO: 2179 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtttcagaa

SEQ ID NO: 2180 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagaagaaaga

SEQ ID NO: 2181 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtggcgcct

SEQ ID NO: 2182 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtggcgccc

SEQ ID NO: 2183 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgaggacagcct

SEQ ID NO: 2184 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagatcagagc

SEQ ID NO: 2185 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtgtctcca

SEQ ID NO: 2186 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagaaaataca

SEQ ID NO: 2187 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagatagatga

SEQ ID NO: 2188 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagagaaagaa

SEQ ID NO: 2189 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgaggggtggca

SEQ ID NO: 2190 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgaggggagagg

SEQ ID NO: 2191 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagaagcagaa

SEQ ID NO: 2192 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagagaaagcg

SEQ ID NO: 2193 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgaggaaaagcc

SEQ ID NO: 2194 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagaggtctca

SEQ ID NO: 2195 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagagggctca

SEQ ID NO: 2196 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgaggactcgaa

SEQ ID NO: 2197 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtctccaga

SEQ ID NO: 2198 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagaaaatgca

SEQ ID NO: 2199 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtccctgat

SEQ ID NO: 2200 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagactgctgg

SEQ ID NO: 2201 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagcagcgtct

SEQ ID NO: 2202 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgaggcacaaat

SEQ ID NO: 2203 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagagacaaca

SEQ ID NO: 2204 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtcacccag

SEQ ID NO: 2205 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagggagatgg

SEQ ID NO: 2206 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagcacctgaa

SEQ ID NO: 2207 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtacatctg

SEQ ID NO: 2208 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtccctcac

SEQ ID NO: 2209 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagcagcagcc

SEQ ID NO: 2210 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgaggaagtcac

SEQ ID NO: 2211 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtttagcat

SEQ ID NO: 2212 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagagagcaag

SEQ ID NO: 2213 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagcacatctc

SEQ ID NO: 2214 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtctctccc

SEQ ID NO: 2215 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagcaccacca

SEQ ID NO: 2216 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagcacgaccg

SEQ ID NO: 2217 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagccactgaa

SEQ ID NO: 2218 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagatcacatt

SEQ ID NO: 2219 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagcagcatca

SEQ ID NO: 2220 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagagaaaatg

SEQ ID NO: 2221 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgaggaaagtgc

SEQ ID NO: 2222 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtccatcat

SEQ ID NO: 2223 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagactccaac

SEQ ID NO: 2224 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagccgtggtt

SEQ ID NO: 2225 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagccagaact

SEQ ID NO: 2226 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgaggcagaagc

SEQ ID NO: 2227 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagcctcaagg

SEQ ID NO: 2228 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagacccctat

SEQ ID NO: 2229 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagagtgtgag

SEQ ID NO: 2230 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagggagagga

SEQ ID NO: 2231 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagattgcgtt

SEQ ID NO: 2232 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagattcaatc

SEQ ID NO: 2233 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagctaactgc

SEQ ID NO: 2234 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtcatctcg

SEQ ID NO: 2235 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagagcgggac

SEQ ID NO: 2236 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgaggaacctat

SEQ ID NO: 2237 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgaggaacagat

SEQ ID NO: 2238 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagttcccatg

SEQ ID NO: 2239 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagaggcgaag

SEQ ID NO: 2240 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagggccgtga

SEQ ID NO: 2241 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgaggtctgtca

SEQ ID NO: 2242 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtccaatca

SEQ ID NO: 2243 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagcgggacgt

SEQ ID NO: 2244 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagacagatgt

SEQ ID NO: 2245 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagaaagtgtc

SEQ ID NO: 2246 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagaagtgtca

SEQ ID NO: 2247 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagagtcttca

SEQ ID NO: 2248 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagaacggaac

SEQ ID NO: 2249 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtccaggag

SEQ ID NO: 2250 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagcatgcaca

SEQ ID NO: 2251 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtgggagaa

SEQ ID NO: 2252 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagaagcggtt

SEQ ID NO: 2253 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagatgtatgt

SEQ ID NO: 2254 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagagagagag

SEQ ID NO: 2255 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgaggctttgac

SEQ ID NO: 2256 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagccactgaa

SEQ ID NO: 2257 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagaagcatgg

SEQ ID NO: 2258 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagaaacatgg

SEQ ID NO: 2259 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagagctatgc

SEQ ID NO: 2260 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagttgccctc

SEQ ID NO: 2261 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagaccctctc

SEQ ID NO: 2262 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtcctctca

SEQ ID NO: 2263 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagccagcagc

SEQ ID NO: 2264 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagacacttac

SEQ ID NO: 2265 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagctggagga

SEQ ID NO: 2266 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagaaagaggt

SEQ ID NO: 2267 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtctctgca

SEQ ID NO: 2268 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgaggaagaaag

SEQ ID NO: 2269 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagaactcctg

SEQ ID NO: 2270 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagcggctctg

SEQ ID NO: 2271 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgaggcaatgca

SEQ ID NO: 2272 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtcaatcac

SEQ ID NO: 2273 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgaggagccctg

SEQ ID NO: 2274 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagagaggcag

SEQ ID NO: 2275 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagatggcagt

SEQ ID NO: 2276 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagcctggccg

SEQ ID NO: 2277 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagaaatcaga

SEQ ID NO: 2278 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtgaatcct

SEQ ID NO: 2279 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagactcacac

SEQ ID NO: 2280 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagacactcaa

SEQ ID NO: 2281 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagagtgcccc

SEQ ID NO: 2282 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagacgctcaa

SEQ ID NO: 2283 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagacacccca

SEQ ID NO: 2284 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagcacttatc

SEQ ID NO: 2285 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagacgtggat

SEQ ID NO: 2286 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagaacatgga

SEQ ID NO: 2287 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagacgtggaa

SEQ ID NO: 2288 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagaagatgtg

SEQ ID NO: 2289 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagagccacaa

SEQ ID NO: 2290 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtatgaaca

SEQ ID NO: 2291 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagacggctag

SEQ ID NO: 2292 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgaggccttctg

SEQ ID NO: 2293 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagttcaaaac

SEQ ID NO: 2294 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagacggtttt

SEQ ID NO: 2295 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagccacccaa

SEQ ID NO: 2296 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgaggccagcta

SEQ ID NO: 2297 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtatggatg

SEQ ID NO: 2298 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtattcagg

SEQ ID NO: 2299 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtcagtttc

SEQ ID NO: 2300 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtgcgaact

SEQ ID NO: 2301 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagaccctata

SEQ ID NO: 2302 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgaggtgtatat

SEQ ID NO: 2303 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagcgatgtag

SEQ ID NO: 2304 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagaagacggg

SEQ ID NO: 2305 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagctcccttc

SEQ ID NO: 2306 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagagagagga

SEQ ID NO: 2307 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagatcctgta

SEQ ID NO: 2308 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagaactggat

SEQ ID NO: 2309 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgaggaccaaga

SEQ ID NO: 2310 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgaggctgccgt

SEQ ID NO: 2311 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagacccacct

SEQ ID NO: 2312 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgaggtagaagg

SEQ ID NO: 2313 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagaagaatct

SEQ ID NO: 2314 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagcctggcac

SEQ ID NO: 2315 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagacaaacca

SEQ ID NO: 2316 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgaggaaaaacg

SEQ ID NO: 2317 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagagcacaga

SEQ ID NO: 2318 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtctcaccc

SEQ ID NO: 2319 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagagaatcct

SEQ ID NO: 2320 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtctcaccc

SEQ ID NO: 2321 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtgaatcct

SEQ ID NO: 2322 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtagcaccc

SEQ ID NO: 2323 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagctgcagaa

SEQ ID NO: 2324 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagaggaaacc

SEQ ID NO: 2325 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtctactca

SEQ ID NO: 2326 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagttcactcc

SEQ ID NO: 2327 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtctactcc

SEQ ID NO: 2328 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagcatgagtg

SEQ ID NO: 2329 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagcatgattg

SEQ ID NO: 2330 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagctacccac

SEQ ID NO: 2331 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtgattgcc

SEQ ID NO: 2332 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgaggtgattgc

SEQ ID NO: 2333 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtgactgca

SEQ ID NO: 2334 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgaggacctcag

SEQ ID NO: 2335 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgaggaaagtgc

SEQ ID NO: 2336 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagccttctca

SEQ ID NO: 2337 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagatgacacc

SEQ ID NO: 2338 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagataaatga

SEQ ID NO: 2339 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagataaacga

SEQ ID NO: 2340 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtctactca

SEQ ID NO: 2341 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagaacgctcc

SEQ ID NO: 2342 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagcagaaagt

SEQ ID NO: 2343 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagaccctctg

SEQ ID NO: 2344 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgaggaaagtgc

SEQ ID NO: 2345 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagaaagtgct

SEQ ID NO: 2346 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagacactcta

SEQ ID NO: 2347 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagaacactct

SEQ ID NO: 2348 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagacactcta

SEQ ID NO: 2349 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtccagcaa

SEQ ID NO: 2350 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgaggaaagggc

SEQ ID NO: 2351 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagacctctaa

SEQ ID NO: 2352 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagacactcta

SEQ ID NO: 2353 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgaggctccaaa

SEQ ID NO: 2354 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagcagaaagt

SEQ ID NO: 2355 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagcactctga

SEQ ID NO: 2356 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagcctctaaa

SEQ ID NO: 2357 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagacactcta

SEQ ID NO: 2358 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagaacctcta

SEQ ID NO: 2359 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagcagaaagc

SEQ ID NO: 2360 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagatcctcta

SEQ ID NO: 2361 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagcagaaagc

SEQ ID NO: 2362 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagcactctaa

SEQ ID NO: 2363 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagaacactct

SEQ ID NO: 2364 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagacagtcca

SEQ ID NO: 2365 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagagaaagta

SEQ ID NO: 2366 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagccctctaa

SEQ ID NO: 2367 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagaccctcta

SEQ ID NO: 2368 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagcagaaagt

SEQ ID NO: 2369 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagacccacca

SEQ ID NO: 2370 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgaggaaagggc

SEQ ID NO: 2371 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagccctcaaa

SEQ ID NO: 2372 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagaaccctct

SEQ ID NO: 2373 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagacactcta

SEQ ID NO: 2374 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagactctaaa

SEQ ID NO: 2375 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagacactcta

SEQ ID NO: 2376 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagacactcta

SEQ ID NO: 2377 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagaccctcta

SEQ ID NO: 2378 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagactccaaa

SEQ ID NO: 2379 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgaggagaaagt

SEQ ID NO: 2380 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagcgctctaa

SEQ ID NO: 2381 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagagaaagtg

SEQ ID NO: 2382 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagcagaaagt

SEQ ID NO: 2383 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagacagaaag

SEQ ID NO: 2384 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgaggaaagggc

SEQ ID NO: 2385 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagagtccaga

SEQ ID NO: 2386 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtctcgtga

SEQ ID NO: 2387 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgaggaacttgc

SEQ ID NO: 2388 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgaggcacacaa

SEQ ID NO: 2389 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgaggcaaaagt

SEQ ID NO: 2390 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagggtaaaac

SEQ ID NO: 2391 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagacaaaagc

SEQ ID NO: 2392 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagggccaaaa

SEQ ID NO: 2393 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgaggcaaaagt

SEQ ID NO: 2394 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagggcaaaaa

SEQ ID NO: 2395 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgaggcaaaaga

SEQ ID NO: 2396 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagggcaaaaa

SEQ ID NO: 2397 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtgcaaaag

SEQ ID NO: 2398 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagaaaagtaa

SEQ ID NO: 2399 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgaggtacaaaa

SEQ ID NO: 2400 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgaggacaaaaa

SEQ ID NO: 2401 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagggcaaaat

SEQ ID NO: 2402 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagaccaaaga

SEQ ID NO: 2403 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagagcaaaat

SEQ ID NO: 2404 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgaggacaaaac

SEQ ID NO: 2405 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagcaaaaacc

SEQ ID NO: 2406 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagacaaaatc

SEQ ID NO: 2407 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgaggcaaaagt

SEQ ID NO: 2408 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagaaagtaac

SEQ ID NO: 2409 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagagagctca

SEQ ID NO: 2410 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgaggggctctt

SEQ ID NO: 2411 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtggaaacc

SEQ ID NO: 2412 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagttgtctaa

SEQ ID NO: 2413 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagaaaacaaa

SEQ ID NO: 2414 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagactggctg

SEQ ID NO: 2415 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagatcagagg

SEQ ID NO: 2416 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagaaagatga

SEQ ID NO: 2417 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagctcatatt

SEQ ID NO: 2418 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagagacaagg

SEQ ID NO: 2419 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagattttggt

SEQ ID NO: 2420 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagttttggtg

SEQ ID NO: 2421 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagacttcaag

SEQ ID NO: 2422 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgaggcaaatgg

SEQ ID NO: 2423 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgaggggaaacg

SEQ ID NO: 2424 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgaggcctgctg

SEQ ID NO: 2425 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgaggttgggat

SEQ ID NO: 2426 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgaggttctgtc

SEQ ID NO: 2427 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagactttcca

SEQ ID NO: 2428 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgaggcaaaggt

SEQ ID NO: 2429 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagctcactca

SEQ ID NO: 2430 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtgggccac

SEQ ID NO: 2431 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagctgatcag

SEQ ID NO: 2432 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgaggctcctgt

SEQ ID NO: 2433 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgaggattccaa

SEQ ID NO: 2434 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagaaagacgt

SEQ ID NO: 2435 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagcaggtacc

SEQ ID NO: 2436 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagacaatcct

SEQ ID NO: 2437 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagaatcgcgg

SEQ ID NO: 2438 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagcctaatga

SEQ ID NO: 2439 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagactgatct

SEQ ID NO: 2440 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagggttcagt

SEQ ID NO: 2441 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagagtaactg

SEQ ID NO: 2442 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgaggtaatggg

SEQ ID NO: 2443 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagctcagtcc

SEQ ID NO: 2444 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtagcatac

SEQ ID NO: 2445 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagggacctaa

SEQ ID NO: 2446 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgaggtgactca

SEQ ID NO: 2447 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgaggttctaac

SEQ ID NO: 2448 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagctcagagc

SEQ ID NO: 2449 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagacaatgag

SEQ ID NO: 2450 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagacatcatc

SEQ ID NO: 2451 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagagaaaccc

SEQ ID NO: 2452 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagagacacac

SEQ ID NO: 2453 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagcccgagga

SEQ ID NO: 2454 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagacagtggt

SEQ ID NO: 2455 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtgacgatg

SEQ ID NO: 2456 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgaggtttgata

SEQ ID NO: 2457 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgaggagcaagg

SEQ ID NO: 2458 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagctcctcca

SEQ ID NO: 2459 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgaggggccgca

SEQ ID NO: 2460 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgaggcaaaagt

SEQ ID NO: 2461 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgaggtcctgaa

SEQ ID NO: 2462 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagaggagaag

SEQ ID NO: 2463 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagatctttga

SEQ ID NO: 2464 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgaggttataga

SEQ ID NO: 2465 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagacggagct

SEQ ID NO: 2466 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagagagatga

SEQ ID NO: 2467 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtcccagca

SEQ ID NO: 2468 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgaggtcagacc

SEQ ID NO: 2469 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagaaggagct

SEQ ID NO: 2470 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagggcaaaga

SEQ ID NO: 2471 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagccacctgg

SEQ ID NO: 2472 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagctgctcaa

SEQ ID NO: 2473 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgaggccacctt

SEQ ID NO: 2474 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagactcagaa

SEQ ID NO: 2475 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagactgggca

SEQ ID NO: 2476 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagatttctat

SEQ ID NO: 2477 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagaggtaagc

SEQ ID NO: 2478 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgaggctccaac

SEQ ID NO: 2479 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagacccaaca

SEQ ID NO: 2480 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagaggtaata

SEQ ID NO: 2481 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagggactata

SEQ ID NO: 2482 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagaagacatt

SEQ ID NO: 2483 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtcctcttt

SEQ ID NO: 2484 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtcgactgc

SEQ ID NO: 2485 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagcctctagt

SEQ ID NO: 2486 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagagttctcc

SEQ ID NO: 2487 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagaccttccc

SEQ ID NO: 2488 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgaggctgaggt

SEQ ID NO: 2489 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtcccacag

SEQ ID NO: 2490 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtttattgt

SEQ ID NO: 2491 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgaggtccaaag

SEQ ID NO: 2492 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagggacattg

SEQ ID NO: 2493 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtgcgggcg

SEQ ID NO: 2494 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagacgcagag

SEQ ID NO: 2495 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagaggccgcc

SEQ ID NO: 2496 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagacagcgct

SEQ ID NO: 2497 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagagaggcag

SEQ ID NO: 2498 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgaggaggtgac

SEQ ID NO: 2499 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagcaagacac

SEQ ID NO: 2500 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagctacctga

SEQ ID NO: 2501 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgaggctctaag

SEQ ID NO: 2502 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtcagcagt

SEQ ID NO: 2503 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgaggcctcaga

SEQ ID NO: 2504 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgaggaaggaag

SEQ ID NO: 2505 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagaccagtgc

SEQ ID NO: 2506 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgaggactcttg

SEQ ID NO: 2507 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgaggtcctgag

SEQ ID NO: 2508 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagcaaaagtc

SEQ ID NO: 2509 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgaggcacatgt

SEQ ID NO: 2510 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagaaagaggt

SEQ ID NO: 2511 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagagaggttg

SEQ ID NO: 2512 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagcctagaga

SEQ ID NO: 2513 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagaccaacgg

SEQ ID NO: 2514 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtggggacc

SEQ ID NO: 2515 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagcaactccg

SEQ ID NO: 2516 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagacgcgcag

SEQ ID NO: 2517 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagctgctggg

SEQ ID NO: 2518 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgaggcggtccc

SEQ ID NO: 2519 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagcctcaggc

SEQ ID NO: 2520 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtgtaggct

SEQ ID NO: 2521 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagaggggcct

SEQ ID NO: 2522 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgaggtagtggg

SEQ ID NO: 2523 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagcactgtgg

SEQ ID NO: 2524 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtggaggcc

SEQ ID NO: 2525 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagggttagtg

SEQ ID NO: 2526 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagcatcacct

SEQ ID NO: 2527 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgaggctgaggc

SEQ ID NO: 2528 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagagaaacca

SEQ ID NO: 2529 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagcatgctca

SEQ ID NO: 2530 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgaggtcagcag

SEQ ID NO: 2531 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagatcactcc

SEQ ID NO: 2532 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagaaccaaga

SEQ ID NO: 2533 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagagctcaga

SEQ ID NO: 2534 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtggccctg

SEQ ID NO: 2535 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagacaaggat

SEQ ID NO: 2536 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagcacaacct

SEQ ID NO: 2537 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtgaattac

SEQ ID NO: 2538 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtggtgatt

SEQ ID NO: 2539 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtatccact

SEQ ID NO: 2540 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagagaggcag

SEQ ID NO: 2541 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagaagggtca

SEQ ID NO: 2542 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagccgcttga

SEQ ID NO: 2543 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagcctcggga

SEQ ID NO: 2544 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtgactgac

SEQ ID NO: 2545 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagacaatggt

SEQ ID NO: 2546 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagcaactgat

SEQ ID NO: 2547 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtcagtggc

SEQ ID NO: 2548 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtcaatgac

SEQ ID NO: 2549 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagctacgcag

SEQ ID NO: 2550 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtctaccca

SEQ ID NO: 2551 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtactgctt

SEQ ID NO: 2552 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgaggaatcctg

SEQ ID NO: 2553 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgaggacgtagt

SEQ ID NO: 2554 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagagtttctt

SEQ ID NO: 2555 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgaggcaagaca

SEQ ID NO: 2556 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagacaggccg

SEQ ID NO: 2557 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgaggggagagg

SEQ ID NO: 2558 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagccagtgtc

SEQ ID NO: 2559 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgaggcggtagc

SEQ ID NO: 2560 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagctgcgatt

SEQ ID NO: 2561 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagggcagaga

SEQ ID NO: 2562 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagactgggtt

SEQ ID NO: 2563 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagcaccccca

SEQ ID NO: 2564 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagggggagcg

SEQ ID NO: 2565 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgaggcacatgt

SEQ ID NO: 2566 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagcacatggc

SEQ ID NO: 2567 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagctggagga

SEQ ID NO: 2568 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagctcatccg

SEQ ID NO: 2569 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtgctcaat

SEQ ID NO: 2570 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagttcagcta

SEQ ID NO: 2571 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagaccacaag

SEQ ID NO: 2572 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagctacctgc

SEQ ID NO: 2573 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagcatgcctt

SEQ ID NO: 2574 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagttacacac

SEQ ID NO: 2575 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtcctggcc

SEQ ID NO: 2576 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgaggacagagg

SEQ ID NO: 2577 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtagggcta

SEQ ID NO: 2578 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagaatttggt

SEQ ID NO: 2579 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgaggatagtaa

SEQ ID NO: 2580 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagaggatcta

SEQ ID NO: 2581 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtgagcagg

SEQ ID NO: 2582 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagaggcagag

SEQ ID NO: 2583 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagccaagcca

SEQ ID NO: 2584 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagccgcgcga

SEQ ID NO: 2585 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagctccacct

SEQ ID NO: 2586 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagagctccca

SEQ ID NO: 2587 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagcgcgtacc

SEQ ID NO: 2588 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtggaatgt

SEQ ID NO: 2589 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagccatcatc

SEQ ID NO: 2590 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagctccaaca

SEQ ID NO: 2591 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagcctcaagg

SEQ ID NO: 2592 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagacccctat

SEQ ID NO: 2593 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagcggtgtga

SEQ ID NO: 2594 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagctaacagc

SEQ ID NO: 2595 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagagcgggac

SEQ ID NO: 2596 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagaagaacaa

SEQ ID NO: 2597 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtcttccca

SEQ ID NO: 2598 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagaaagaagt

SEQ ID NO: 2599 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgaggagggagg

SEQ ID NO: 2600 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagaggcaaag

SEQ ID NO: 2601 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtggccgtg

SEQ ID NO: 2602 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgaggtctgtca

SEQ ID NO: 2603 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtccagtca

SEQ ID NO: 2604 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagaagtgtct

SEQ ID NO: 2605 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagaacggaac

SEQ ID NO: 2606 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgaggggcttaa

SEQ ID NO: 2607 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagaaagtgcc

SEQ ID NO: 2608 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgaggcacacaa

SEQ ID NO: 2609 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagagagaggg

SEQ ID NO: 2610 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagacaaacaa

SEQ ID NO: 2611 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagggagaggg

SEQ ID NO: 2612 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagacactcaa

SEQ ID NO: 2613 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagcaaaagag

SEQ ID NO: 2614 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagacactaca

SEQ ID NO: 2615 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagacacacaa

SEQ ID NO: 2616 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagagactcaa

SEQ ID NO: 2617 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagacatgcac

SEQ ID NO: 2618 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtatgggta

SEQ ID NO: 2619 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagacatgttc

SEQ ID NO: 2620 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagacatgtac

SEQ ID NO: 2621 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgaggggaagaa

SEQ ID NO: 2622 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagaagcggtt

SEQ ID NO: 2623 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgaggaagagag

SEQ ID NO: 2624 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgaggctttgac

SEQ ID NO: 2625 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagccactgaa

SEQ ID NO: 2626 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagcagctatg

SEQ ID NO: 2627 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtccaaaac

SEQ ID NO: 2628 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagagcagcac

SEQ ID NO: 2629 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagttgatagg

SEQ ID NO: 2630 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagactggagg

SEQ ID NO: 2631 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagatcctcat

SEQ ID NO: 2632 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagaaaaaggt

SEQ ID NO: 2633 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagggtcagga

SEQ ID NO: 2634 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagaggcatca

SEQ ID NO: 2635 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagaactcctg

SEQ ID NO: 2636 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagcggctctg

SEQ ID NO: 2637 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgaggctataaa

SEQ ID NO: 2638 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagaccgaccg

SEQ ID NO: 2639 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagctcaatca

SEQ ID NO: 2640 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtctgggca

SEQ ID NO: 2641 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagacagtcag

SEQ ID NO: 2642 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgaggtctccag

SEQ ID NO: 2643 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagaagcactg

SEQ ID NO: 2644 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagagaggcag

SEQ ID NO: 2645 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgaggatggcag

SEQ ID NO: 2646 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagacaatcag

SEQ ID NO: 2647 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgaggaaagtgt

SEQ ID NO: 2648 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagcaggctca

SEQ ID NO: 2649 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtgaatcct

SEQ ID NO: 2650 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagattcacac

SEQ ID NO: 2651 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagacgtggat

SEQ ID NO: 2652 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagaagtggat

SEQ ID NO: 2653 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagacgtgaaa

SEQ ID NO: 2654 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagaagatgtg

SEQ ID NO: 2655 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagcgcatgtt

SEQ ID NO: 2656 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagagccacag

SEQ ID NO: 2657 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagattgtgaa

SEQ ID NO: 2658 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagacattgcc

SEQ ID NO: 2659 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagcggctagt

SEQ ID NO: 2660 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagacggcatt

SEQ ID NO: 2661 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagaggagtcg

SEQ ID NO: 2662 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtggttcaa

SEQ ID NO: 2663 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgaggccagcta

SEQ ID NO: 2664 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagccagctag

SEQ ID NO: 2665 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagatgaatgc

SEQ ID NO: 2666 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagatgcatgc

SEQ ID NO: 2667 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtattcagg

SEQ ID NO: 2668 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgaggtctcagt

SEQ ID NO: 2669 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtgcaagct

SEQ ID NO: 2670 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgaggtgtatat

SEQ ID NO: 2671 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagctacctta

SEQ ID NO: 2672 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtatctcac

SEQ ID NO: 2673 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtctactta

SEQ ID NO: 2674 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtcacatca

SEQ ID NO: 2675 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtctactta

SEQ ID NO: 2676 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagcagatcag

SEQ ID NO: 2677 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtctactta

SEQ ID NO: 2678 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagcagatcag

SEQ ID NO: 2679 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtcttatgt

SEQ ID NO: 2680 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtatgtaca

SEQ ID NO: 2681 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtcttatgt

SEQ ID NO: 2682 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtcttatgt

SEQ ID NO: 2683 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagcatgtaca

SEQ ID NO: 2684 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtcttatgt

SEQ ID NO: 2685 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtatgtaca

SEQ ID NO: 2686 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagctatgtgt

SEQ ID NO: 2687 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagcatgtaca

SEQ ID NO: 2688 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtcttatgt

SEQ ID NO: 2689 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtatgtaca

SEQ ID NO: 2690 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagacatgcac

SEQ ID NO: 2691 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgaggtgtgtat

SEQ ID NO: 2692 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagcatgcaca

SEQ ID NO: 2693 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtgtgtgtg

SEQ ID NO: 2694 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtacacaca

SEQ ID NO: 2695 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtagtgtgt

SEQ ID NO: 2696 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagttacacac

SEQ ID NO: 2697 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtcacatgt

SEQ ID NO: 2698 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagaatatgtg

SEQ ID NO: 2699 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagcgcatata

SEQ ID NO: 2700 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagcatataca

SEQ ID NO: 2701 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagcacatata

SEQ ID NO: 2702 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagcgcatata

SEQ ID NO: 2703 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagacatatac

SEQ ID NO: 2704 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtgtaggtg

SEQ ID NO: 2705 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagatatatgt

SEQ ID NO: 2706 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagacatatac

SEQ ID NO: 2707 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagcagacaca

SEQ ID NO: 2708 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagggacacca

SEQ ID NO: 2709 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagactcacca

SEQ ID NO: 2710 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgaggtgaaaag

SEQ ID NO: 2711 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagctcccttc

SEQ ID NO: 2712 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgaggaccaaga

SEQ ID NO: 2713 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgaggctgccat

SEQ ID NO: 2714 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagcctggcac

SEQ ID NO: 2715 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtacaaacc

SEQ ID NO: 2716 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtgaaccct

SEQ ID NO: 2717 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagcaaatcct

SEQ ID NO: 2718 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtttcaccc

SEQ ID NO: 2719 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagctgcagta

SEQ ID NO: 2720 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagagaaaacc

SEQ ID NO: 2721 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagccattaca

SEQ ID NO: 2722 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagatgattgc

SEQ ID NO: 2723 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtgagtgca

SEQ ID NO: 2724 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagccaggatc

SEQ ID NO: 2725 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagacagagtc

SEQ ID NO: 2726 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagagtgtgac

SEQ ID NO: 2727 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtcgtgaca

SEQ ID NO: 2728 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgaggagcttgc

SEQ ID NO: 2729 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgaggactccgt

SEQ ID NO: 2730 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagctcactca

SEQ ID NO: 2731 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagttgggttc

SEQ ID NO: 2732 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagagtaactg

SEQ ID NO: 2733 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagacatcatc

SEQ ID NO: 2734 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtaacgatg

SEQ ID NO: 2735 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagacacatgt

SEQ ID NO: 2736 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagagggacct

SEQ ID NO: 2737 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagagcaggcg

SEQ ID NO: 2738 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagggctctca

SEQ ID NO: 2739 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagcttgggct

SEQ ID NO: 2740 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagggtagtgg

SEQ ID NO: 2741 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagacatgaac

SEQ ID NO: 2742 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagacatgcac

SEQ ID NO: 2743 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagacacacat

SEQ ID NO: 2744 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagacatatac

SEQ ID NO: 2745 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagatgaacat

SEQ ID NO: 2746 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagatacgtgt

SEQ ID NO: 2747 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagatcatgtc

SEQ ID NO: 2748 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtgtgcatg

SEQ ID NO: 2749 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgaggcactcaa

SEQ ID NO: 2750 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgaggtatgcat

SEQ ID NO: 2751 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtgtttgca

SEQ ID NO: 2752 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagttgcatgc

SEQ ID NO: 2753 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagttcaccac

SEQ ID NO: 2754 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtcacacac

SEQ ID NO: 2755 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagggtgcaca

SEQ ID NO: 2756 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagctccaagg

SEQ ID NO: 2757 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtacaccac

SEQ ID NO: 2758 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagactgagcg

SEQ ID NO: 2759 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagactgtggg

SEQ ID NO: 2760 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagagctcaac

SEQ ID NO: 2761 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtcagaagc

SEQ ID NO: 2762 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagcctccagt

SEQ ID NO: 2763 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagaccaagag

SEQ ID NO: 2764 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagcccccatg

SEQ ID NO: 2765 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagagctgcct

SEQ ID NO: 2766 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagcagacttc

SEQ ID NO: 2767 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgaggaggacac

SEQ ID NO: 2768 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagttgacttg

SEQ ID NO: 2769 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgaggtgcctca

SEQ ID NO: 2770 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtcttcacc

SEQ ID NO: 2771 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtcattgct

SEQ ID NO: 2772 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgaggaataagt

SEQ ID NO: 2773 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagggaccccg

SEQ ID NO: 2774 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtttggttg

SEQ ID NO: 2775 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagttttctgc

SEQ ID NO: 2776 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgaggagtgagg

SEQ ID NO: 2777 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagttacagcc

SEQ ID NO: 2778 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgaggaaaactt

SEQ ID NO: 2779 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagcttcaggc

SEQ ID NO: 2780 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagttcagtca

SEQ ID NO: 2781 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagcccacagc

SEQ ID NO: 2782 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtctccaca

SEQ ID NO: 2783 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagagggaagg

SEQ ID NO: 2784 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagcgagccag

SEQ ID NO: 2785 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagggtggact

SEQ ID NO: 2786 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtccatcta

SEQ ID NO: 2787 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgaggagcgggg

SEQ ID NO: 2788 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagttctttcc

SEQ ID NO: 2789 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagctaggagc

SEQ ID NO: 2790 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtgcccacc

SEQ ID NO: 2791 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagttttttga

SEQ ID NO: 2792 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagcgtaggca

SEQ ID NO: 2793 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtcctcctg

SEQ ID NO: 2794 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagctcaactc

SEQ ID NO: 2795 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagcttacatc

SEQ ID NO: 2796 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagggtaccgc

SEQ ID NO: 2797 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgaggctgtgtg

SEQ ID NO: 2798 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgaggcgaccga

SEQ ID NO: 2799 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagcacgcggg

SEQ ID NO: 2800 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagagagaagg

SEQ ID NO: 2801 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagcgacaccc

SEQ ID NO: 2802 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagaacatttt

SEQ ID NO: 2803 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtggaggcc

SEQ ID NO: 2804 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagttccccct

SEQ ID NO: 2805 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtctacata

SEQ ID NO: 2806 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtttaccca

SEQ ID NO: 2807 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtctactca

SEQ ID NO: 2808 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtctattca

SEQ ID NO: 2809 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtgatggac

SEQ ID NO: 2810 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtagtggac

SEQ ID NO: 2811 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgaggtcaaaat

SEQ ID NO: 2812 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtgtgtcag

SEQ ID NO: 2813 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgaggctctgtc

SEQ ID NO: 2814 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgaggccactgg

SEQ ID NO: 2815 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagacagttgc

SEQ ID NO: 2816 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagaggaggac

SEQ ID NO: 2817 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagccagctcc

SEQ ID NO: 2818 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagcgtggccc

SEQ ID NO: 2819 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagacaacaaa

SEQ ID NO: 2820 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagaaggatga

SEQ ID NO: 2821 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtccaggtg

SEQ ID NO: 2822 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagccctatgt

SEQ ID NO: 2823 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagcatgactg

SEQ ID NO: 2824 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagcctgaact

SEQ ID NO: 2825 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagcatagcct

SEQ ID NO: 2826 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtgaattac

SEQ ID NO: 2827 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtagtgatt

SEQ ID NO: 2828 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtctaccca

SEQ ID NO: 2829 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtgtcttga

SEQ ID NO: 2830 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagggcttaga

SEQ ID NO: 2831 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtctactca

SEQ ID NO: 2832 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtctattca

SEQ ID NO: 2833 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagactaatgc

SEQ ID NO: 2834 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagatactgag

SEQ ID NO: 2835 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgaggtaactgc

SEQ ID NO: 2836 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagatactgag

SEQ ID NO: 2837 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagtgactgct

SEQ ID NO: 2838 - DNA, 18 bp, Artificial sequence
  Synthetic nucleic acid sequence
  misc_feature (1)..(1): The nucleic acid is detectably labeled with 56-FAM at the 5' end
  misc_feature (18)..(18): The nucleic acid is detectably labeled with 3IABLFQ at the 3' end
ttcagttgagcaggccgg

SEQ ID NO: 2839 - RNA, 82 nt, Artificial sequence
  Synthetic nucleic acid sequence
gcaguccucuguuaguuuugcauaguugcacuacaagaagaauguaguugugcaaaucuaugcaaaacugaugguggccugc

SEQ ID NO: 2840 - RNA, 22 nt, Artificial sequence
  Synthetic nucleic acid sequence
aguuuugcauaguugcacuaca

SEQ ID NO: 2841 - RNA, 23 nt, Artificial sequence
  Synthetic nucleic acid sequence
ugugcaaaucuaugcaaaacuga

SEQ ID NO: 2842 - RNA, 87 nt, Artificial sequence
  Synthetic nucleic acid sequence
cacuguucuaugguuaguuuugcagguuugcauccagcugugugauauucugcugugcaaauccaugcaaaacugacugugguagug

SEQ ID NO: 2843 - RNA, 23 nt, Artificial sequence
  Synthetic nucleic acid sequence
aguuuugcagguuugcauccagc

SEQ ID NO: 2844 - RNA, 23 nt, Artificial sequence
  Synthetic nucleic acid sequence
ugugcaaauccaugcaaaacuga

SEQ ID NO: 2845 - RNA, 87 nt, Artificial sequence
  Synthetic nucleic acid sequence
ucucagccugugacccucuagagggaagcgcuuucuguugucugaaagaaaagaaagugcaucuuuuuagaggauuacaguuugaga

SEQ ID NO: 2846 - RNA, 22 nt, Artificial sequence
  Synthetic nucleic acid sequence
cucuagagggaagcgcuuucug

What is claimed is:

1. A method comprising:
   determining an amount of each miRNA in a set of miRNAs consisting of:
   mir-19a, mir-519c-5p, and mir-345; or
   mir-19b, mir-519c-5p, and mir-345,
   in a sample of blood or blood product from a male human subject suspected of having prostate cancer, by
   a) reverse transcribing RNA from the sample using a primer that hybridizes with mir-19a, mir-19b, mir-519c-5p or mir-345, to generate a reverse transcription product encoding mir-19a, mir-19b, mir-519c-5p or mir-345 and
   b) detecting an amount of the reverse transcription product encoding mir-19a, mir-19b, mir-519c-5p or mir-345.

2. The method according to claim 1, comprising measuring the subject's PSA level.

3. The method according to claim 1, comprising biopsying the subject's prostate.

4. The method according to claim 1, wherein the blood product is serum or plasma.

5. The method according to claim 1, comprising obtaining the sample of blood or blood product from the subject.

6. The method according to claim 1, wherein the determining comprises performing quantitative real-time PCR to determine the amount of each miRNA in the set of miRNAs.

7. The method according to claim 6, wherein the quantitative real-time PCR is multiplexed.

8. The method according to claim 1, comprising administering prostate cancer therapy to the male human subject.

9. The method according to claim 1, wherein the male human subject is undergoing prostate cancer therapy.

10. The method of claim 1, wherein the primer is a stem loop primer.

11. The method according to claim 1, further comprising assaying an amount of one or more reference miRNAs in the sample of blood or blood product.

* * * * *